United States Patent 7,629,444 (NUCLEOTIDE AND AMINO ACID SEQUENCES FROM XENORHABDUS BOVIENII STRAIN XS85831 AND USES THEREOF) - sequence listing, part 5

SEQ ID NO: 14983 - DNA, 235084 bp, Xenorhabdus bovienii
  unsure (1)..(235084): unsure at all n locations
  Genomic contig Name=Xb4151_4152.C442
tgcttagctgccagtgttttgcggcttcaccgaacgagtgtgagcgggtcagttgcccccattgggnaggtattccccccaagctggattgtagtatcgtcccgattgttaggttctgaatctgcataaccattaagactaagtgacaggcacaataggctggtaacaaaggactttgctttactgagcagaaaaaaatgacttttggggtgcactggcatgttactcttttcattgatagtgaaagcggtaacatgccgaaaacaggactcaaatactgcgtttaattcttttttttatcggagaaattacaagcattagcggcttatctgaaccccattaaaggtatgagtacaacattgacacagaacaggaatatcctttgcggataagtggggattgacctttcttaaaaaaccggatttatcgacaaacagcccgttataataacttgattcaccgcagcgaatataatcccgttgatcattttcatgtagagcgactatccaaaatacaggatctacccgatctaatctctgaatggcttcactatagatcacatcccattgttcaccaactttactcaatagaaacataaacaacggtgtataatccaagccccgtctgtgtttacttttcatgggaaggaagtgcggcatatcttccctgatcaatttttgtttggtacgttcccatcggtattcaccaccatgatgataaacatgatgtgttgttgtatttacccgacggtagagtttcttttttcctcgatttgattgatggtctctcatttaggcactcatctcaatttttgatattataaacaaggtagtgaaaaatgaaggcattagatacattccatcacaaaatataatcaatgacttgtttgttcatacagaaccggaatcaacctttaacccccgtgcgatatccatttttctggccaccagaaaagcggcttccagttcactgcactgatgttcacgcattaacgccctacgctcggctttttcttctttttccgtcatccccagcgccagatacaggcttgggggcaccacccgaaacaaggcttcgatttttttcgctaataccacaccttcagtataacaacggggtaatttgctggcagagagcaatacggctttttcctcttccgtcagtttcttaaaccgggcgatttgctccacttcatccggtggcatggtcagacacagccaccattcagccatattcagcatcttttcagcagtatcggggtaatccgccaggttttgggtggcaagccacagccaggtccccagtttacgccacattttgaccactttagtcatatagggtgataacagcgggttggtggtggtgatatgtccttcatcaatcaccagttgcagttcgcgatcctgatattgatcccgttcagccaggttattgactttgttgatgagtgacaccatcgccagtgccatttgcgccgagtagttctcccgtgccagtgtgcccaaatcaatcagggtgacatccacttccggccacgacgtaccggggcggttaaacagttcaccctcaaagccttgtgtaaacattgacatggcgctggccatttcatctgcccgtgcccgtcggtgagcggtgattaacggctggccgtgttcatcctgccggtgattacgggcgatggcataaagggcattctgtaaatccgaggccaccatctggcgtttctcgttaaagctggtctgcgccgccatcataatggcctcacgaattaaaccgcgatcagagcgggtcaggcgttcttcttctcttttctcaccaccggtgatcatcagtcgggcggcaatttccatttcgcccaggatatcgcgctgttcatccccctcctcttcctgttgttcatcggtatcggggatatcggcttcattaatgcgcaattgcttgggactcagtttcaacagttgatgggcatcggcaaacagcgccagactgacgccacaacccggtctgataccgattttattgaccgtcagccccagactttcatagtaatcggccagcaagccaaaactgtttcccgcctccacaataaacagacgcggccgatgtactgccattaactggatgagcgaggcgcacagggtggcggatttccccgcgccggtcggaccaaacagcagtaaatgggcattctgggtgcgatcctgtttgttcatcggatcaaaggtcagcggtgccccgccccggttaaagaaactgaaccccggatgcccggtgccggtcgaacgacctgtcaccggcaataacccggccagatgctgtacccaggtcaggcggctgtacccgtgttttttgtctttctgcgggttaaagcacatcggcagtgcccgtaaccaggcattcagcggtgacacactgaattccggccggacgggctgtaatccggctgtcagcagggtggaggataattgatgtacccggtggtttatatcatccagatccctgccccgcaccagaaaggccagcgcactgcggtacaatttatgccgccgccccagaagttctttcacttcctgcacatcctgccggacgcgcagcgattcagtattttctcccaccgcatttttcgtcagccgggtaaaatcctcttccagcctgtcctgtgcctgcgccacaatggtcagcgaaactaccgtccctgccggcatcatatccatcagagtattgatattgtcgccccgtttcacttcgcctgtcagtgttcccggttccggcggacggcgcagacgctcaaccagcaccgctttatgcggtaacccgtcaaaccaccagacgcccgcgtcgggatcagacaccggcggggtaaaccacaggctttcagcaaagtcattgttgacggggagatccgatagggtggtggtaccataactcaccgtatggtaaaaatcggcttttgccatcccccaatccggtgccggattaaagtgacgtaacagccaactgtggatctggccgccatgttgtcggcgggcaatcacaccggcagaagccagtgacgagaccagacgttcgcagacctgattgagcgcagccaccgctgataaggccggattgctaacatgggatctgcgcccgtcaggcagccaccgataaaccaccatacgggtctggcgttgctggccccgccacggttgcccggtgattaagctgtcctgaaatatcccgtcaggccgggcaatgctgttcaggtgatgctctgattccgtcagaaaggcgtcagtaaacagtgttccctgtgcccagggtttcacatagccccgcaaggtgttgagatagtcagcaggatcatcgtcatcctgacaaaaaaactgcaccacccacggcgaaatatcatcttcttccagactgtcctggatcgcatcttccagttgatcccggatttcagtcaaccgctcagcgggacggccttcggtggcaatggattcaatctgatagaccgcgccgacggaaatcccgtcatccaacaataaacattgcccgtcttccagatattccacccagggcaggtaatcgatgatggaagggtttgcatggtaaatagtagtttcatccgcctcacgcaatttaccgggacggttcagtgccttgggtttttccattacagtgcctccgtgcgttcacccgacagggcatattgtacttggctgtaaaatgggaacaccgtgctgtagcccggtatcggcgtattgccggcgaccagatgcggaaaaacatacatcaccatatcgggattgggtaagcggggaaactgttggctgatttcctgcgcggctgaacggctgtaatgatagggttcttccagtgccctgagccgttcagatacagttaaagaacggcgcaatgtttcccttgccgatgcggtggcatgaccggccttattcccctgccacattgccagcaccgtttgctctccggcaggtaataaggtctctttcgaggtagcacagccggccagtaaccccgccagacacactatcccataatattttattttccacatacggcggtctccggggtgccaaagacggtaaacgtggcaaattccgggtgtactgccagctctgataaggtaaaaggcaaaggcttccactgttcaggcgccatgctgactttaccgtccaccactgcctgccactgggtttccgtcaggcggaaaacagtaaaatctccgtcactcaacggctgacattctctgccggctgaaagatacaaccgacactcttttttgcgcactgtacgccagtaaagctgtacctgtgcgggttcagcccgtgacgtcaccggcacttgcaggcaatacggggaacccgcactgaatatccactgagaaggggtcttttccattaatctaatgcttcctgattgtcacgttgggcggcctcacgcacgccgtagcgcaccttacgtcctttcgtttcgtaatcaatcgccaggcgttgtgtgatatgcaccacaacacgggcaccgggcgggacgtaaatcgcatcaaacgtctggctgtagcgctgtctgagccattcgctcatgtcattcatgccacctgacatcgctttgcccaatgcggcctgtccggcattgcccgttaacgcggtggtgataccgcctgtgccgctggtctgggcagtacgctgactttcactcagggcatcgccggccgaatgcatggccgagagcgcaaacagggtcggcagataggtggcggcgttggatttgcgctcaccgctgatacagggaatgccgttttcatcagacagccagccgatgccgttcgcgctggtattgttgttttgcccgctgcccggcagggtacgcaccgtgccatcctgaaaaacaaccgtgatggaattgacctgaccgcgcacgcaggagagtgtccagtcgccactggctgagccggacaccaccgccccttccacctccggcagttcaatgccgttggccgtcaggttgtctttgccgataaggattttgaatggataagggtcagtcactgcaccattgacgggaacacggcctaataacgcggtcatggcctgactgcccactaacgtggcattttcaggcagggtatagaccggctgttcattttcttcctttgatgggttttgaagcgatgggctttggggcttactttgcccggcggctgactgttcacttaaaaatgaggtcgggaactgcgccgtggcttttccactgccgggggtttgtatgtctgcgggcttttcatcggccggtgttatccagataagttcattctgccctgtgcctgcattggcagaatacggaatacttcccgacccaagtggtatcggactgtccggcgcagacaaaggcgctgaatttaagcgttccgtcagtaaatcaatctgtgccagcaatccctgctgttcatcctgtaattcacgccggcgctgttcatcgtcctgccggatagctgccaccgccgcgtctatctgaccggcgacatcctgacgctgattttttaactggtcattttctttcaggatatcggcattctgctgacctaagcgttgctgctctgaccgcactttattgagtgttcccaccagcgtacgcaaggtatcttccggcgtatcaccgccgacacccagcgcctgtaactcctccggtgacaatgtggccaggacattgttgggtggcgtatcgggcgcggtagtgtcggttgagctgcaacttttgatgccgataaacccgccgaccatcagcaccatcggcaccaggattttcaccagactgttggatttaacctgcatgacggcctcccggtttcactgttaccggctcagggataaaagcattatccggctgtcctcgggtcacaagatacagcactgtggtatcttccggtgtccctgcttcacccagccaacgatgctgaaacgttgctgcgacaaattgcccctgcaaggctcgtgggtcgagcgtaatgttgcgtttggccgtattacgcagtttcagggctaccaccgtgtaattttgcatgccccagccggccagcggggaaaccgcaatcggttccgacggatagacggtggtgatggcggcgggtaaatgcagactgaccgggtggatccccgtaaccggctcgacggtacgcagcggggcataaagctgctgagcggcatagcgggttaatatcacaggcgcgggagccaaaggtgctgattttctctgatgcggtgccccctcttttggtacagaatttttttcatccggataaagaatgcggacgggttccgttggccccgttttggtggcggtaatatccagtaagataatttcgccgttttcactgtcctgcaattgcagacgggtagacggaaaagattggctggctttcaggtaaatggctccccctgcgctctgcacccgcagtttatcgctgagtgacggagacaaaccaacacggacatttctgtctgcgaaaataatccgctcctgacctaccttgagggcaatggataacggaatgcgttcccatttcatcagttcatcagcctttgcaccgaggctgaacagcacgaggctgaccaatcccagccaaaaacaggcagaagagcaagatggatatcttttcattggaacaccccctttttctcttccacaggttgcggcatcgcttccagacgctgcggcatcctgtcgtaacaatccagtgccagcccgaaaggattacgctccgcatcgccctcccagcgcaccactttcagggaatagcgcaccagcgcccgtttgaccggctcggcgtgataatattcatcggccaccaaatccagccgcaccacccagttatcccggttacgcaccgtcacacttttcgtcccgtagccccggccggggatctcatacaccacccgcacccgatcaagcagctcaccactgtcggcccgggttttggcatcctcctgcaaaaaatcctgacaggcgggggtcaggtaaggcgacaaagccgcaattttagccgggtagtcctgtgccccgtttttcggccaggcgttcagttgctggaaaagataaaaggcaaaactgtagacactcggcgcaggcacttcccaccacgggcgggtgctgccgctgcgtaagtccggcggattatggatggtgagactacgcggtgacgtcatccagcccgtgagcgtaatcagcaagaccagtatcagcaccccgcagacaagccgcagggtcagaatatgctggtcacggtttttcagcgcatgacgaaaccggctcatcgcaggctcccgttacgatgagtcagcctgcttcgacgcaacgaccaaccctgagccgcaataatcaatgccggatcaccgatacccagccggcgttttttctcttccagtgtcagccagagataattttccggtttgccgcgcttaagctgagcgagccagcgaccgccaaaactaatcaataacaagggcatgaacagcatacccgtcggtatcatgacccagccggctaacgggataaaaggaaggctcaccatcaacccgaatgccagccccagcaaagcggccagccccatttccggtgtggtgaatccgcgaaatacgaccggttcggcatttaagcgatcgggtaaaaacgggatcgtctgcatcagcggtacctcaaaagataatgccggccgatttcgccagcagccaaatcaccgcaaccaatagcactacgccgaccacgatgatcgagccaaactgggtccaggtggctttgccgtcccgcacttccgaaaaggtttcaaccgccgccgacgcgaccttaaaaaacgccactgccgaaaggatcagcccgccaatcacaatgccatcctgcgcatagcctttcacctgtcccagtaatccgcccccgccgccactttttggcggttcgatggcaggtaaatccgcccaggcggactgacaggaaaagccgaacagcaaaaggagtgtgcttattctggttatcagattcgcactgagacgacggcagacggtaaaaattggcttcatgttcaatccattcctttttcattatgttcgttgcatcagctggcaaacatccagaccgcaaccaccagtaagatggcggttcgcatggcaaactggctgatggtctggttacgtactttttcattcgcccagccgttccagacatcgaccgcggcccaggcggcccagagaaacagggtggccaggaaaaatccgacgcagaccagatacagaaaagtgatatcaaaatgccccgaggccacggtaaaggcagtgcgttgtgcctccgtcattacgggcgttcctgacggtaatgaccggataacacgtttgattcctgctgctgggcgcgggaaggggtcaggtagtgatcaataccggatttaatggtgttgagatccgctttgatacggaggtaatcaaagtcatagcgagggcgggttggggtgtcagcctgcttttcagcgaggtttgcgcgctccagtgccatctgcacctgctcaatcagattttttgcactcgccagttcgtctttctcggccgcctgcgcaatcggtacacacatcaggatcagactcagcagacaggcagaacgggacagggaaaagtaaccgtgcataaacattcacctcgttacggatttcaggatgccgaggatgcggggttttttagggcagatcagcaataaactctttatgctttggtgaaaattagctaaatagtctgactaatttatttggttaacgatttaagaatgaaggaaaacacatgctgcggattgatttaaacgtccccgatgatgaatacgagcaggcacggaagctgggtgcacactgggatgccgccgcccaaatctggtatattgacaacagttttgacccgacgccgtttatgaactggttgccgttctacaatgtgcacgctgaattctggtatctcgcccagacccaaacatcctgcccgcactgtcatgaacacaccaccgtgacggcgtttatgctgcctgccggacaccagctactggaagcggataacggcgatgaacccggcacggaagttgactacacagagcaggacagcccggcgtttttgttttatctcgccgatattccctcactcgtgcgtaacgtgctgcccggttttcaccaccgccttcgcaaagcggtcagccagcgactgcaccggcagcactggataaaccactgcgaacactgtggtgcacaacaggatgataccgaactgtttgcagaaatcggcggcgcattttttcctgcctccagagagcaagcggcgactcttcagctgcatcgtatcgatcagccgtttgtggggtattgtgaagatatttcgcatcatcactaccattttgacccgaagcaggataaccgtatctgtaaagcgtgtgacgggtttgagtggatgacgcaggtggtgaatgcaccgtcaaagtaccagcattagcctgaaagactgacgcgccgctgggcggcttgtctgctgacgctgaactgcaaaacaaaacccgttttgcagttcagcgtccagcatcattagctataaatactttttaaatattgagactgccatccgcgtcaccatacacagcatcatcgtagagcatcagaataattcttctaataaaaaggatattaatcctcatacgctgccattttttcgtaaaaggcttcatgaagcctttctttttctaataatgcagcgtctctcaattcatatttctcccgtttctcctgaaatgtattctcaggatcaatttcttccacgatctcgaaaatacctgataagtaatctattagagagcactcagataaccaaaactcctccacttcttgccttgtaatcgggtattcaccattttcatccagttcagacgtataaatccaaatacgttggtctcccggatgagcgatcgaaaatagagcaggtaaatcaggcgaatcattccagattggcattaaatcttccatttcaacgtcaggaatgttactgacataataggaaccataaaaagcaaattcatcaggatcccatgaggttattatatttttttctattgaatcaatgagatattcaaatactttattgccataagggttggtgagatcgcaatcataagcaagtaacgcggagaggctcttcggtagaggtgcagtttctgttctgtttggggcgcggtattttcgcagacgaagacgattcaatttttcgctgggcattggattaaggactgtattcttatttttcctttttatagcagacaaaaatgtatcaaattgattttccattattgattccttttaacaattaataccgaggcaagatgacaaaaattctttaatcaaattaattcaataaaatccacagcgacatttgtactttctgtttttgaaagtacgtcagactataaatactttttaaacatcgatgtggtgatcaccactgccatacctaaaaatagcgctgctggcaacaatatcaccataggatacaccacattcggccacgataaatacagtacacagggaaccgtgcaggccggttttatccctcgcttggcatggtgatagacaaaactggattcatacccggctccgtaacgtcgtaagtcccgacgtcccagcccgtcaaccagtgccaccaaaatcaccatcacaaataagggtacgtataacaacaaaattaccagtcggatcagcgtcaccatcgtgataaacaccgtggccagccaatattcttgcaaatagcccgatacaccctgtaatacggaatttaattcacgcataaaatcattacggctatggaactgatattgtgattgtccctgaacccagttcataaaaccactgtccacaaacagccattgataggcttgcgccaaccctgccgaaacggtttgtgagggttctgacagcaacagacttcgggtaaattctgaggagagatagttaagctctgtcttcatcatgttctgactgtgagcggcgccctgttccggccagaaaaaagccataccgagatattccagtaacaggctgaatagccaggacatcaccataaacccaataagttgccacggccattcccataacagacgatacaacaggccatgcttgcggggcggttgggaagattgacgggagggattttctgattgagccataaccggaaactaccccttctcttcccaccaattttcactggtgcggtagtgcctgcgcatctgttcagcgatgttctgcaaattggccggcatcagagcatcatcgtcatctcccgttggcaaaggcatacggattttccacaactgcccaccttccaataacgcaaacgcctgccctttcggcaagttaatcatttcagcgggcgtaattagtggtgttttgacggtgcctaccctatcttgtgtggacgaggtaaaatcctgcccctgttcaacatcagcaatatctgaatgccccgataccagggtcttactgtagatttccacttccggcagctggctggtgagaagttctgccgtccggttatcccgcacacgcaacataatcaaagtgttgaagttacctatcacctgcgccgttttggccatgctgccgatacgggcctcgatatcggaggaggtctgggtatatgccgtcacctgcatgcccgcgccgccacctttattaatcagcggaataaattcatcgcccatcagttcattgaattcatcacaatgcaggttaatcgctagcttaccgtcatgacgtaccggcaatccggcgttcatgccatatttgtaaatttgcccggcgacactgaccaaatctgcaaacatgctgttgcctaccgccgaggccacatcactgtcagacagcgcatccagcccgatatagacaatcccatttttgcggatcacctgttcccagtcgaagataggacgcagatccgccatattgagataatccggtgacaataattccgcaattttgcctgtggtcagtttctccagcagcggcaataaggacgcgacaattttatcaaaataggtacggtcataacgcacggcagaacgcagaccatccagaatcgggtcatagagttgcttgcctgcgtcagaactcagcgtcatttccatcgcccagagccggagggcatcgggttgcccctgcatattgcgcggaatgtctttttctttcagtttgctgagggaatgattgatttgcgccagcagatccggctgtctttcctccatcattcgggtggcatagcgctgatacagttcgctgatattattgacgtagcgggtgatgagctggtaatccggccgatgccccagagccaccaaagctcgggcaacaatattgacaaaccgccaggcaaattcacggaacgcggcgctgttgccttcgccgctgagctgaccggccagacgggaagccacttcggacacccggccaaaccgcccgacggcgttataacgcgccgaaatctccggccagcccagatgaaagagggacagttcattgccgcgacccgcgcggtgcgcttctgcccaaatgcgccttaacagatcagcgtcgcctttgggatcaaagacgatcaccacttcaccgcgccggatatcctgcgtgataagcagttcagccagccgggtttttcccacacgggtagtccccatcaccagcgtatgcccgacccgttcgcgcagatccataaaaacatcagtctcctgtggttcaatcccgtggagtgccggattaccgcccactggtggcagcggacgtaccggattaaatggcgagtctttgcgtaatagcgcagataatgccggccaacggtattcagttcgacgctccagtgcgcgggcaagctgataagcctgagacggttgcacaaatcgttcgacctccggtcgtcgcgtatcctgcaaacgctgggtatgcttctgttgccagcgaaatcccctgcccagaaacaactgccggtgactgacgggaatttgcctggtgctcatctggtaacgtggcaggcgacgcaggtttctgcgataacggatgacctgaataccctgccatgtgcgtatcattgccagtacggcaaaaccgcctgccatgacatagctgactgaaggtgccagtgcgatggcccaaggcgccctgatacagacaaaagccgcaacgactgagaccaccgcagtattcagctcgacggcaggacgcagcagggcttcaaccacataatggcggctcatggtgataactgttgggaaagttgagtttccgtgatcaacaccggataatgttgcagttgcaatcgacgagccagctcggtgccggaagcaggcgataacaataaatccggtgccaatgcccgcagtgactgcaaacccgccatttccctgacattgacgaccagacccacagcatgcagtttcgtcaatgtggccgcattctggcttaaccaccggcgtgaaccgggatcatccccaatcagaaacagtgccccaattcccggcaattgcagtggtctgcttgacacttttcccggcgtcagctccagtgttttgacaggcaacatcgccgcttcacctgccatttcaggtgaggaattttgcaccgatgacacaggctcatcgcgttgctcagcattaatgctttcataaaaaggcgaggcatctttgccgcctaaatcggcaatgatgttcagttcagcatggcaggcacttatccataacaggccgataacgggaaatacactcagccgtttcataatgatgtgatttgccatccctgctctccctgccgtaataaaatcggcatgatgccctgcccgaaccggaaccagtaccccgcatcatgattcaatgtgatgtgtcggttgcgtacccgttcaacggggatacggtgttttttggcccattgccgtagtgtgtcatcattgcccttgctgtcgaccagataaatgtcaatcggttgcatcaatgccagaacttccgctaaacgggcgtcacacggcgggcaatcgttgattttgacaaacaacgccaaacgcccctttgcctcaccggatttctccatattgaccggcaacatatccggaaataatcgttgccaggcggcatccacttcccgctgaaaacgcagttctttttcagtgcgggcaaattccgctttgacccactgctcagcataacggcggcgttctgcatcactttcagcttcaatccccagggttgtcaacggatcaagccccggcgactgaattccccttggaccattcaataattgctgataacgccgatattcatccgtgctcaatccccattgcccggcctgtattctcaatgtttgcttttggctttccaccgtatgtgcctgctgcgacgttaagggtgacggtgtggctgcccatgttgggctgatgagcactatccacgttaccagaccgatttgatgtaatctcatggctgctttccctgccggggttgtggaagctgataacccggccgcaaatggtgacaaacctcacgttgcacctcatccacctccagttgccaggccgggcctgccataagctgcaaagcggtacgcagccggacagggcctaactgatagtgcacagacggcaacggctggcgatataaaatgtcattggttttttcaggcgcacataaccgataacccgactggcgtaatacgtcacgcagggcatcggctaccgtgggatgctgagacgccggaatatgaacctcaatcaattgggaaagcggatcacgctgtgctgctgttgggtcggtacttaccaggatataacgaccgtaacggactacttccggcgcttgttgataaatatcgggtgagacgggctgaatattgcgcgtgagctgcgttgctgaaatggctttttcggaagcacattgagacggcggtttatttgacggggcattgcaacccgtcaggatagtgaccaatacacccattaatacggttattctcattcctgttattcctgcccggcaatcaaagcgcaaagcgccaatgtgcaggaaataacaggatttattcaatcaacaactgaaactgccttttaggaaataaaaacgttatcgcttattgctctgaagattctgctgaaaccgttttacgcacggtacgctcaatcaactgaccatattggtcaaaataacgactcggccagatttcagagggatgaacatcgagataatttgcaatgatccattccccttttggccaggcgcgggacagggtgttggcgagagttgaagagcttaatccggcttcgcgggagacggcggcgagtgttgtaccacgcttgcgtaatgcgcaaataatttcggctgggtgccagtctttctgagtgtgagtcatagtcatacctgcttccccttcttttgattattgaatggtggcgattcaagacagggattctcaggtaccgggtacactcaaccggtgagacgttagtctcccccgcctgaaccgccatagaaggtgcgataacaggcacactggtagaaacatcctaccagtggagtgtttttatgaggcctgagattcctcactatcggattttgccgatagcttttttactttaacgaattccgttatctaattcaataatcgaatgtgtaagtttaacaagttaataaaattgttggattatgccttctgcatcaatttaacacataaaaaaacccgcctatttgcgcattctctcaatgaaagactcagcgtggcaggtgtacttaaccacgattatacccattaagccgcagtcagaaaagtgtataataaggcaaacttgaatcgcataatgctgaaaaggcaatattatgaaaccagtaaccaataatgaccatttaagccgaattaagataacaggctacaaatctattgcggaatgtgatttaccgatgggatgcctgaatgtactcattggagccaatggtgctggaaaatcaaattttatcagtttctttcgcctcattgccaccgtacttgatcatcgtctacagtctcttgttggcaaaatgggcggccctgatacattgctgcattttagccgtaagaaaaccgaatatatgagttctgaactttattttggtcacaatggctataaatttgaactggaatccaccaatgacaatcgtatgatgttccggcatgaatcactttttgggaatatcagcggtgattatgatatcggctcgggtcattttgaatctcaggtcgataaacatcacacaggcatcaacgatgataccttacctgccatgctccgttggcgggtgtaccattttcatgatacgagtgacagtgccagagttaaacaaactcatcgtattaatgacaatgattatctgcgggaggatggtgccaatttagcggcatttctgtatcgcctgcaaaaacatcatccgcagcattacaggcgcattatcaaaacccttcagatggttgcaccgttttttggtgatttttacctgcgatccactccggataatgccgattacattcaactcgaatggacagaaaaagagcaggacattccttttaaagccagtgaactatctgatggcactctgcgctttattttattggctaccgtattgctgcaacccgaaaattatatgcccggctcaattattattgatgaacctgaactcggactccatccctatgccattaacgtactggcaggtttgatcaaaaatgccagcaataaacatcaaattattatttctacccagtcggtcgaactggttaaccaatttgatgctgacgatctgattgttgtcgacaagcaacaaggcgcctccacttttaaacgcctgaatcatgaaatgctttctgaatggcttgaagactatagcctcggggaattatggaagaaaaacttactcggcgggagaccacaacgatgatccgcatcaatgtttttgtcgaagggcagacagaagaaactttcgtgcgggatgtgctggcaccttatttttctgcacagcaaatctacctgtcccctatattggctcagacgagtgccagccaaaaaggcgggatcacaagttatggcaaagtaaaacaccagattacccgcttgtgtcggcaagatcccagtgcgttcgtcaccacgctcatcgactactatggcctgccgactgatttccccgattacaacaaacaacgggataatgctgccagcgaacgggtagtgaagctggagcaggcttttgctgatgatattgggcaggccaattttattccccatctgttattacatgaatttgaagcgctgctattttgccaacccgaaaaatttgcagactggcttgatgacagcgcccccattgctgcactacaagccatcagaagtgaatttgctaccccggaggatattaataatagcccgcaaacggcgccatccaagcggattctaaccatcatccctcattatcataaaaccttgcatggcccactgattgccggtgatataggtttagataccattcgctctcaatgcccgcattttaatcagtggttagaaatgctgactaatttgatagcacgtattcaatttgctccgaaaaaatagaaacaggccctgttttcacagggctatacgttaatgataaaaacaccattcagaacgggatcgccgaatcccagtcggtttcatcctcttccggtgaaactgagacctgtaccggctgcgtgttttttctttcctgattagcgggtttaggcggtggctgcttttgtgctggcttatgccctgcctgttgaggtgccatactctttgaatcattacggctccccaacatctgcatcgaaccattcacatttaccaccacttccgttgaatagcgatcctgaccctgattatcctgccatttacgcgtttgcagttgcccttcaatgtaaacctgagtccctttatgcaaatattcctcggcaatttctgctaacttgccgaagatcaccacccggtgccattcggttttttcccgcaattcgccggtttgtttatccttccagttttctgacgtagccagtgaaagtgttgccacggtaccccctgtcggcaggtaacggatttccgggtcttgtcccagataaccaagtaaaatgactttgttcacaccgcgtgaagacatcttgttttctcctgttatcgggggtgacgttgtgtccattgcccctgtttcagggcaaactccgcctgttcacgtcgggcaaaatactccactgactcacgagagcagggaatgccttcatccatcgtgccgatataaaaccccgcacggcggcgcaaaacgattaacggcagttgtttatggcaatattgcagggccagaaacccaatcggtgcagcattcatcacgatatccttttatttttggtcattaataaagacctgccctgaacgttcagggcagctcagcggaatatcagaaagagttctctgcatattctttttgcgtgatgccgttctgaggcggcatcgagtcggattgttcggcctgatacactttctcctgaccgattttaatccagtcaaccttaatcagacgggctttcaggctgacgcgctgttcaccggcatggtctccgcgtttcagggtaaagatatcagtcgagggattgcttaaggtaaagcccagcaacacttttttatcctcatctaccgccttctggcaacggccgaccagactggtcgcttccttgccgaccacggtgatatcaaaacgcacataaaccgggttatcacctggtccgttcagcgcattgatcacacagctcaggaacgttccgctggcagtgctgacatggcggatgttattcagatagcccagtcctttaatattgaggttgaaatagtcgtttttggttaaggatgcggtgttctcagacattcgatgttctccatgcaggtaaaaaataaggtgtgacggagaaaatcctgtcccctgacgggaatgatttttcccgccgggtgtcagacgcatacgttgctgacgtactgataaagaataaaaaaaccttcactgccactggactgacaatatctgctttcaaaggtgggcagatgtaccgcaatcatgcgctccctttcaggctacgggagttttcggctaaaacagcatgatttttaaagcaccagtccgtgcggtcaatccttaatcccattttcagtccggtgaatttccccgccgggtttttcgggagccggtcaccgcgttagcgttcagcatccctttgcatgccggatagcgagtgcagccccagaacggggttgtttttcccgcccgtttttgcatcgggccgccacagcgcgggcacgccggggttttcggcagggtaaaccggatcggctgtgttttgcccttttccactaaatgcgccagccattgtgcctgtttctgcataaagccatccagtgtggcccggccccgggcaatgtcgtccagagactgttcccacagcgcagtcatccccggatgggtcaggacgtccggcagcccggcaatcagctcctgcgccagcggcgttgcatgcaggtttttcttttttcgcgccagcagctgacggttaaacagggcttcaatgatacctgcccgggtggcctccgtgcccagcccggcattttcccgcagcacttttttaagctgcggatcgtggataaacgcagcggcatttttcatggcggcaatcagcgtaccttcggtaaaaggcgcaggcggccgggtttgccggggctgtatttctgcacggagtaccgggcagatttcctcttttttcaatgcaggcagcgcggtattgtcgtcctgctcctgcacctgtttttcatcggcaaacagcgtcttccagcccgtgaccacactgacccgccctttcgcctgaaatacctgcccgccgatagtgaatgtcacgtcagtcacatccgtttcctgtacgggcagaaactgcgccagataatagtggcggatcaactgatagatctttaattcgtccgcggtcagtttcgtcatatcaaaagtgtggcgggtcggaataatggcatggtgcgccgtgatttggctgtcattccagactcgggagagagtgctggcatccagctggctgataatggcattcatcgcaggatcggtacgggtcagtgcggtgaacacggccggaatatcttcccgcattgaaaccggcagataaccgcaatccgtgcgcgggtaggtggtcgctttatggatttcatacaacgactgggcaatcgtcagtacctgaccggcccccattccccattgacgggaggctacctgctggagcatccccaaatcaaaacagagcggcggcggggttttttcccgtttctgcgtgagttcagtcaccacggcatcttgtgcctgctgacaacgctgaaccacactctgcgcgatatcctcccggatacagcgtttttcttcatcgcaatcgtcgggcgcaggcagccatttaacccgaaagctaatgtcatctttttgcaatgcggccatcacctgccagtagggttttggctcaaaccgggcgatatcgttatcacggttcacgaccagtgccagtgtcggcgtctgtacccgcccgatggacagcacctcaccaaatccctgtgcctgcgctttcagggtatacaggcgggtcaggtttattcccatcagccagtccgcccgtgcccgtcccagtccggcctgccagagtggttcggtttgctcccccagtaatatcgcggccagtgcctgccggatactggtttcatccagcgcagacagccacagccgtctgacggggccggtaaaacggcaatactccagcagttcacgggcaatcacttccccttcacggtcagcatcagtggcgataatcacttcgtcggcctgtttcagtaattgtctgatcaccgcaaactgatcggcggtctctttcttcacagtccattgccactgcacaggcagcaccggcaggggttccatgcgccacggcgggccgaattgttcaccatagtgctcgggtgcagccatttccagcaaatgcccgatagcccaggtgacagtaatactgtcgccaaagagatagccctgtccgcgctgcttcacgcccagcacccgggcgatatctctggcctgagagggcttttcacataaatacagtggcatatcaccccctccctgcatcctgagccaccgtgcgcagggggggtgaaaaatcagaacgcagccggcccgacagaatatcggggtccggttcgcccagccatttaatggcttcaaggccagccggtgttttttcctcaatatccgcacgggtcaccttcagagggcggtaagaacgcaccagaccataaatctggcggatcacccgactgccgttatgcagcaacgcatcccgctctgaacgagaaataaaaccgtaatgaaacgcctgaaaggttttcatcgccagctggtcgaaaccgaccaacagccagacacagcggtaacccagcggggagtgactgtagaccccgatattcagcggttcaacagaggaaaccgcggataacgtcacctgtgccggcagggcgttcagtgtttcctgcaaggtggcaatacgctgctgaaggctggccgaggccgccaccagggcctgttccagtttcatcagccagctgtcggcatacgggttatcggcagccgcatcctcactgatggtgcccgcccgtttaattacctgcggcatgccgataatgtccgggtattgacggcggccggtgacgtcttcttttttacgccctgcccagaggcggatggcgtagtgggtatggagttcaatggttaacgtggatttcagtgcaccggcacgacgggggggcgacggtgcggttttttcatcaggttcagacataaagagcaactcctgtttggtcggtttatgtctgtgggactatcaggggaaaggtgtctgcgactcaatagataatcagttatgaaaaaaggaaaaaacgaccccttttcgggatcgtagaaaagattatttttatcgtctttgtcgcccggctaataaagtacaatttttagccgtctgtgccccgggcacaccagtattatttttaaccactgctgtctcaggcaatacgatagattttcagacttgcctgcctcaaacaaggcagtacaatttttagtcgcctgtgccccgggcacaccagtatgattttcaaccactgctgtctcaggcaatacggtagattttcagacttgactgcctcaaacaaggcagtacaatttttagtcgcctatgccccgggcacaccagtataatttttaatcattgttgttccgggcaacacaacccggtttttaccccatgtcatcacggtgatattttgcctgcgccagccgctgacgaatatctttcactacactgctgacatgggcttgtgaagaggggggaacagaacgcgccgtttcccgtgtgaattcaacgggtttcttcgcagccgccgtcgtcgtgacagccggttcagcctgcacatacagttttccctcccgtgcccgtttcatcatcgccagcagccagccgaccggattaccgattttgcctgcctgtaacgccttatccagacaagtcaacacagtctgcgcctgttcagcaggcagtgcctgcaactggctgttcagcatccccccatcttccggctccagttgcctgcataacttttccggcagaaaaatagcggacggtgtatctacgtatgtttttttattcacactctgtgtgaaagaacgtacataacagttcggtttagtggtttgacgacaagtcattgatttcacgctgagttcggtttccgaattcggcttattctgcccttttaactgaccggattcggtttccgaacccggtttcatttccctgagttcggtttgctgttttccctgttgaagcgcctgcctcatgaccctttgctgtggcgtctgcaccgcattcagccgcgcttccagcaaacggatatgactgtgacgatgacgcatcagtggatcttcttgaatgtcagtcagtacctcccgtgccgtctggctgatagtgcggtttttgctgcgacaggcttctgccacagtattcagccagtgaggatcgagaatctcggcatcacggcaggtcagcggttcatcgtgttgcgcatagatattgccccgcacccgcccatgctcgtcgcggatacgcttgcataaactcagccagccggttattcgcagcatcagcaatacccggctgacggtttcacgggaggctttgcctttatagggcgaggccagcagcagctgcaattcatcgtagctggggaaaaccgccccttcattttgttgcgcatacaaacggatcatcatccagcccgttttatccagtggtgacaggcgatcatccagtaacaggcgacggggataggcatcctgaatgttacccataaacagcagaccactgcgcagctgtgaaacgtcatcgtcggggcgttgttccagacggcttttcattttggccatagtgtgggcaattaagctgtctgctgacaggtttatcatgatcccttctctccggtgttaatctgtgaaaataatgtcagggctgcaccctgtggcgttgcacaaggcgcagaatgacacgacttcagtcacatttacgatttacgaatttcattgttgtagcgttcgtggtgcatcagctcccacgattgcccgctatcacggcttaacaaccgccagaacagccccacgttgattttcagatacccggtgcctttttccttcagccggacgtaattacgctgaccccgccgataacatttcacctgatattgcgccttacggcgaaaggacagcggtgccgttaccggcacatgcaggccgggcatgatttcggttaattttcctgacatcgtttcctgtatgacccgttttatccctgttttttcacagagaccgatccggatgcaccctgttgctgccattctttgacggcattccagacggacgtcagcgaaatatcatgatgctccgccacgtccatcatgatatccagcccgtcggcactgtccgcatccctcatctttgccgcctgccagcgctgccacaggtcacggttttccgcttctgtcagcaccgaaacccgccccgacttcacggcaataccggcaatacgccggcgcgccgccacctccagactggacaggccaaaaaaatagtgcatcaggtcaatcgatccgctgagggccagtgcccgatcaatgcgttgtatccgttgctgttcgatacgcgcctgatgtaagatgcgggccagattggcgtgatgaatttgcacactcagcaccgataccgggctgttgcccagataatgcaaatcctcaatcgtcaggctctgtaacatcagcatctccgagggtgccagccccagtgcttcgcaacggcggatatagccgttcttcaaatccatcaccaactgcaacaacaggctgttggtcgcttgcgataaatgattcatacacttcctccattatcaggccagtcaaaacacaatgaatgagcaacacactgaaaagcaggcaccccggaccggtatcgctacatcgccaacatctccggcaccatttcgcgctgaagttcacgcaggcggcggataatccgcagcagccgcagaaacttcacggtctgactgtcatccagcaatggcaccgcctcccgtccggcggtgccgagcagaacggcagtcagcgtcagttcatgacggtcagtcgagatttccccggtcagggagtgcaataaacacgaaaaaggatgaacatccggcccgtcaatcaggcaaaatcccgccgaccgttcatccgataccggcagcaaatcacggtcacagcccatcacttcggccagttcaaacgccaggcgaaacgccatattttgcagatggtcgatatcgtcctgcatcggggaaatgtgccagactgagctgaccggctccagcccggtccgggcaaagtgaagatcgtcggcttcaggctcagacagtgccggttcaggcggactatccggctgataaggcgggagcaccggattgtttcgggaagacggagcaggcacgggtgtcttatcgaccggagcgcatgttgtctccgatgcctgctccgcatccgtggcgggttgagacattattcgccggttcggttccctgtctggcgccctaatccgatccgctttaggcgtatccggcttttccggcacagggtcaagcggggtggcctgttcaccaaagagttgccggcggttactttccttcggatcgagttccagtacccagcggtcataattcagctgcgggtgcggtaatacctgcaataaatcgccgataagttcatcccggaacatctccggcgaccaggattccggggagtcaaatttgcggcaacaggcaccaaaaatcgcatcaaaggaacaggcaggctccgatattgcactgacaacatgttgcagccagacagcctcggcatcctgccgtaatgccagtaacaaacgaatttggggtaccttcagccccgagttcagcagatccggcatccacggatagagatattgcacggtatcttccatccggctgatataactgcggctgacaggaaaaccggcttcccccagtagtgcagacaactcactttgggtgattttctgctgtttctctacttcaaaaagggttctggccttgcagacccccagggctttttcaataaaactgagttcaccgcgcagttcattttccgccagatgcccgatgacacactgcaatctgcccggccacggtttaaacaggcagtgaacacgataaaaacgctcatcgccggtttcctgccacagttcggacaaaatctgatagcgggtattgccgccatcactgaagatataaacatcatcaccttccgggtcacgggtaactttcggcaccgtatccagcccgcgtactttgatcgaggccttgatatcctcataacgcgggttccgactggtgcgggggttatccggattggggcggagttgatccagtgtcagtaccatcggcatttccgacacagggggttgttcactgagtgtcgccgcggcctggcgcccttgttgtaacagggcattgcccatattgagaggttgccgtgccatcatttccccccgtaaccatcactgtctgcggataagtccaaaaaccgcgtatattggccgtcaaatcccacacgaaccacgcccgttggaccctgacgctgcttaccaataatgatttcagcgatacccgtatcgggtgtgtccgggtgataaacttcatcgcgatagagatgcagtatcaggtcggcgtcctgctccagtgagccggaatcacgcaggtcaccattattaggacgtttatcggaacggttttcgacctgccggttaagctgggacagcgccagtaccgggcagcccagttctttgcccaacgctttcaggttacgggagatatcggcaatttcctgtgtccggttttcctggccgggcgcacacatcagctggaggtagtcaaccataatcagggcgggtttaccgtatttgcgggtatagcggcgggcacgggcgcgtaatagtgcgggcgtctgatgactgcaatcatcgatcaccagacgctgatcccagcgggtaaactgatccagactctggctgatgcgtccccactgctcatcatccagcatcccgctgcgcagggcgctcagagaaaccccgccttccatggcagtgaggcgcagcatcagttgtgccgccggcatttccagactgaaaatctgtaccacggcatcatcccggtgccgcaggacacccaagcaacaggccagtcccaacgcggttttccccatcgaagggcgggcagccagcaaaatgagatcaccggcctgcaagccgccggttttttcatcaagatcctgaaatccggtcggtgtgccggttattccctgtgagccttgtattcgctccagatgggcaatcaggctgtctgcgccctgcaacagggtcatttcctgatgctggcgggtcgaacctttttcagccagattaaacaactgactttctgcctgctctatcagggtatctgactgaatattcggctgaaaaacgtcagcgctgagggattttcccagtgccagtaactgacgtaaccggcttttttccgccacaatacgggcatactcctcaatattggcggcactgggcgtgtttttacacacttccgctacataagcaaaaccgcatgcccgatcaatttgcccacgctgggtcagcctatcggtcagggtaatcaggtcgaacggacagtttttttcgctcagttcagcgatggcctgaaatattatccggtgtgccggaaaataaaaatcgtcggcaaccaatagctggacaacgctatcccagcgctcattctccagtaccagcccccccaacacccccacttcggcatacgcatagctgggcgcctcttcactgatgatctgtaaatgttcatgcgccatgtccatcggctgcctccctgctgatcgcattcagggcagcgattaaacgctgttgcagatgaggggaagaaacccagaacagcacctcgttatgggtcagatactgcggctggtcattttcccagccacattccagcaacgccaaatccggagacgcatcggggcgcatggcctgcctgcgcatacggggataataatgctctaccccttccggagaaacatcgggaacagctggcaacaggatctgaagtttcgcctgcgcggtttcacgatccggcgcatccacaaacacaaacctctcatcatcactgaacagtaattcaacgcgctcataacgaaagcagaccgcccgccagataacattcattgcgcctctcctgtcggttgcacagtcaataccgcgtcgaatttttccgcccataagggcactaactcacaggcgaggcggtgcatggtttgcgcggcagccgggctttttcgggtggttttatactcaaggcgatgaacgggctgggcacggacatgccccagtttgtagatatccagcaggtctatccgggtttccagcagctggtaaacctgcctgccacccagtgcggaagcgtcataccgttgattattgataatgtcagccagttcactcagcgtatcccggtcgagattcgttccttcaatcccgttgaccagtatctggatagccggcagccggataccgtagtgttcaaaaggccggagccgggtcagcatccgcagggtgccgcgcaggaactcgcggacgtcgggtaaaataggcttgataacccccagcacgccctgcgtggccgccagtacaaccagctcgttcatcacgccggtcgcccctttggaatcaatgaaaataatatcgtactggctgaagagaggatgttgcaggacattgcgcagacgcaaacgcccgtcgggcgcgtgcagcattgccgtgggcaggagttcatccggatcgttggagatcagaatatcgaggtttttgataaccgaacgggaaatgatctgctcagactggttcagatctaccgtctgcatcagcaactcatatagtccggcaggcgcttcatagttcaggggaaaaatactgctggcagtgggttgcgaataatccgcatcaatcaggagaacacgtaaaccggcatcggcaaaaaaacccgccagattggcggagtgagtcgatttaccttctccccctttgggggaaattatgggaagaattatcatgttgtacactcaataaattcaattagttaagtgtacaaattgtcaaattagctagttttacattttattaacttacgatgggattgaaaatccccgtgtccttggttcgattccgagtccgggcaccaattttaaaactcgtttgttgaagtgatatcaataacttaacacgtgagtcagaaataagtgctgttaagcaaatgttaatgaatataatctattactttgcgtaagttaataaactaaaaatagccactctatacgaagtcaggtgaacacagtttgtgctcacctttttgcgttgaaagtaatgatttcagtaattgattctgatgtcaagtcagggaattgtcagaactgacctttgagcacacttcccggtttcttcgttttgtgtctccacctcaaaaccatcccttaatccaatgacacagtcagggcaaacccgctgatatcctgccctgtttttttacctcacgttaacgaattactctgcaatatccagataaaacgccagttcattcgccagggttttacccgcgatttccatatcgatatcaatatattccatcgtggtcgccagactacggtgtcccagcaaacacctgaccagctgcaaattacgatcgggagccttcatcaactctgtcgccagcgtatgacggaaacggtggggcgagacggcaaaaccacactctttagacaggcggttaaagaaagaacgaagatgctgcttttctctgtcatgatgatactgataactgacatggcgtccgtgataacgaaaacgcagacgggttaaatcaaacagtggatcattctctttcgcgccacaggcttttgcctgttcaaccagctgcaccagccggggtttcagttgcgggatcatcggcacccgccactcactgtggtttttactgccttccacgcgcaactcaatgtaactgttgtccagattaatatcccgcaaccgcagatgcaacagctggttcaggcgcatgcccgtcagccggaaagtatccaatacagtcagccagtaccctgtcgggtatagggcacagcgtccgccccgtggggaagtctgtaaacgttcttcctcctcatactgctgcatccgcaggtaaatcccggttatctgagctttactcagggttttcttttgtttcttctcttttttgactgacgcgtcattaaacggatttttggggtgtgacaacagttttctttccatgccgaaattaaaaatggcccgcaggtgcgccaccttattgttccacgtataccgggactgatttttttccgtcagcagatgacgccgccagcgcaggacatcccggtgagtcacgctctccggcgactccgtttcccccagataccggataaatacccgcactaccttgcgataactccattcggttgccggccgtaacatccgtgagaagaaatactcgtccagcaacgcatcccagcccattgtttcctcattatttaacatattattgtttccttggtgtgtaatattgtgttccggtacagaaacgtcccattaataaactgcaaattaattaacacgttaaattattttatttgtaagcgtcaactaaactacaccttgcttatcacttttttccagggcagtagtttttccagatccggggtgggttggcataactcatccaggcaagtcatgacataatcgaaagggatcaatccattggctttggccgtttcaatgacgctgtagaggatcgcactggcttgtgcaccgcgcgaggtatggctgaacagccacgcctttcgcccgatgacaaacggtttgatcgccctttcggcccggttattgtcgattgacaagcggccatcctcacgatagcggatcagttttgcccattgattgctcagataagtgacggcctcacccagcttgcttttggggatcacctgggatcgggttttaaccagccaggccgataacttatcccagataggaagcgctttttcctggcggatccggtatttttctgccgggcttaaccccttgacctgatgctcgacccggtacagtgactggatcaggctcagcgcgatatcggctttgcccgttttgttttttccctgcgcctgcttcgcttccataaatttacggcgggcatgggccatgcaaccgaccagccgggcaccggtctgctcatagccttgatagccatccacctgcagataaccttgaaaaccggcgagatagtcagcagcgcaggtgcctgaacggctggcctggtggtcatacagcacaatattcggtgtgagcgccgccggttcgggggtatcagtgcccacacaatagacccacatgtaatgggtcgttttttcagacgtcaccaccttcaccggggtttcatccgcatggagaaccggttgttgcaacagcatttccctgaacctggccaccaacggcgtaaacaactgcgcggattttaatatccagtcactctgggtctggcggctgaggtcaatgccatactgtttgaacacactttcctgacggtacagcggtaacccatactgatatttactggtgataagctggctgagcaggctgctggtcgccatgcctttcttgatgggcatcgctggcaaggaggcttgtttgacaggcgtctgaatgccggatttttcacattcacggcaggcgtatttggggcggacatgctcaaccaccctgatttgagcgggaatgaacaacagtttttcactgcgatctgcccccatctgatgcaacctgccgccacagcacgcacactgtttttcttcctcggcgatatcatggaacacggtttcgcgcggtaaatctttgggcagggggttgcgtgtcggcttacggcggggaggtgtgagggtttcctgtgcggcggccgtttcagccggcagcgcaatttcttccgcttcgttaaacaactccccctggccggggaacgcttccgaggaagccccaaaccgtttttgttgggctaaacggaactgctcttccaaaaaggccagccgctgcgactgcttaatcagcagccgtttcagttcagcggggtcattgggcagggcatcaatatcaattttcatggggacattttatgccatccccggcgaaaaagcgtaattaatgcccgttggtttgatgatcatcaagggatcaggcgacatggcaatcctgtacggagaagggctggtgcccgatgacatcataacccgataacaacccgtgcagttgctgctctgtcagggtcagggaggcactgttgacggcggtgggccatttgaatttcgcgttctccagccgtttgtaccagagcgcaaatccggttttatcccagtagaggattttgagtttatcccgcttcttgttgcaaaagaggaataacgcggtttgcgtcggagacagttgcatttccagctccacccagaccgccagcccgttgatggattttcggaagtcgataaatgagcggcacaaatacacctccggcacatccacaaacattttcatgcggcgagcccccgaataatcgcaatgataacatgcttatccgtgccggcaggaaaacgcagtgtgccatgtggtgtctcaaataagatggggagtgtgctggatgaggcggattttttctgagcggtgctgactttaataaaagcagacggtgaagccagcccagacggcttttttggtggatgggaggtgcgttggcggtggtgatagaaccgggttgtcgacacaccgattttttggcaaaactgcgggacagtcagttcggattttttctgctgttcaaacaggtcccgccactcggcttgagtaaacctggattggctcatgtgagttttttccatcatcagaataggtgaaactattttaatcaatggatttatcctggctaggtggggttccccgtacgcttacttttatttttcatatagtgaccttttatacattgcggaaacaaggcattccggcactgatgcggtgcatttggataatttcaaatcgttatcgttaccatttgtattatttttcatcagaatttcattcctccgcctgaaacaatgacagtaatgtccgggtatcctcggcggtgtcaggcgcaggggctgttcccggtgtgactggcggaataaccggatcgggttctgatgatgacagcctggtatcggtagcctgtttagcagattcaacgggattcagcagcggtgactgcacctgctcagcggcagactgaagcagtgagtccgtcaacgggacagaagacggatgtccgccaagatgcaacatcaggcactgccacgcaccgggcactaaagacagccaggtcaccgcttcctccggtaacaaacgggcagccagcagcgtcttataaaggacaggcagctcaggccccggtgcctgaaaccggaagcggaaacgacgttcaggtatccacaatcccggctgccagtgatgcccgtcttccagttccccttccagttgccgcagcagaggcaggtggtaaaacagcgccgcccagaacaccaccgcctgccacagcagactttgtgcggcctgtgtttccggcgccacccccggaggcaacatatgcccttttgccagccgcacggcacaggcagtaaattgcagggtcagatcgataaatccgccgcgacaagaccagatgccctcttgtgtcgcgggaacatgctgcacacgggcgcataattgccggagcggatccagatagaattgctgatacaacccggcgggcagcgcactgttttcccacagttggcggagatactggccacgctctgaagttgccagcagcacctctgctgactgtggacggaaataacctccggcaccgcgtattctttcaggcgcttgcccgggcgctttttgtgacggggaagggtcacgggtaaaacgggatttaaaacgctgaaacatcacttttcctctttcggttcagatttggctcagtgtcggtgaatcccggccggaagtaaggaacaactctttttgcaaaaatgaaaattaatctgacccggttcatctcctgactgacaaaatcagcttaattttcaccataaccccttgtattaacgccatttaaaaacaaaaaaaaagcgccccgaaaggcgcaatagtcatcgttgaaaaaatgcgttcaggcggcgataagctccgcctcccgcaaacgctgagaccagttgcccagataatgcgcgggcgtataacgggttcgcttgtcaccaccatcatgcaaggcattgccgatggtgatggcggccggaatcccggtcaacgagaactggatataggccatcacggccgccagcgggtcaatatcaatcgcgtaaacccacaggctgcacaacggatcgtgtcccagctcccgcaatacatcggcagcggccagcgtgatacagcccgcaccaacacaaggttcacacagagtgacaaacggttgtgtctgcaacagcccggcggcatcctgcaactgcatctgtgccatcattctggccacactccagggggtaaagaactgctgaagatccttatcacccagttccagctgcataaacacactgccgagaaaatcaccgggttcctgcaccagtccgagcaccacatgggaaaacaactgtacgatccggtcaacatcggcccgttcgtacttgttaatggttttcagataatactgctccagctcctcactgaaacagtgcttattgtggatcgctgccatggcacagttgcaaaaatcccggaagacctgataacgggtatgataacgtgccgtttgcttaaacagtgaaatgaattctttctgatgatcggttcgggaggccattgggtgttttccttgctgaacaaaaagcgaaaaaaggaaaacacgccccgaaaaggggatcggttcccctttcggttgacatgataagttcgtctaaaattaatcagtgaaacagctggttactgtccgactgcgatggccggcagggccaatgcggcttccgtctgctcgccagtgaccagatagagtgccggccggttttcccgtcctgactgcccgtgaccgctgtccacgtgctcgccctggtcatagcaatcatagcctttgaggctgcctgacgcatcgctgtaccaatgacggatttcacagtcaaacatcgcggacagttcccccatcagctccgccgaaggcggtgcccagggagaatcaaaacgcacggttaaactgctgacattccggcgctcccagcggacatggtgaccaaacggccattccagcccgtattgttcctcataaaactgcgctgtggtgggaatgcctttcagtaagccactgttgccgttgatttcggtggccagattcgttgacatcatcatcagcatatcgcagggctgtgccgcctgcgggtacacattcagcttatcccagcaggccccgatatccggtgtatcagaccagcccaccataccaaaccagtcgatatactggcgggtcagcagacgagcgataatatcacgcgccgcttccggcaccttgtcccactgcatcaggctgagaccggactgtcggtacaggttatcaatgcgtttgatattgtcattattcaacggcacattattctgcaacaacagcaaccactgctcaaaggccagatgctgcgccgttggcaccgccgtgccgcgcaccagcgccgggtacggagtgtaggtttgtggtttagtcggtttcagtatccccgcacagcctgccagaaacaggcgaagactttgtaacaccgcctgacggtaacgggggacttcttccccgcagacccactgctgcattacatcgagacaaacggatttgccggtgatttccagttgattggtgcaccattctgccatggttaagttcctcacttgaatgataagaataaacaggaggaactgcccacccagggcacagttcccccgatgggtagattgaacaaaaaggattactgtccggtctgcctgaataacctgtcagccagaccactgtcaaaaataaccgtcagctcatcgtggatatccagataaggggtattgcgcgggataacctgcgtgttcagccggattaagtcgtatttatccaccagttcgttaatggcttctgagggccggacaccgcgggctatcagtgctgccaccgtaccggtttcacacaataccgtgtcagtcagattcaagccaaaatgccgtttcagcaaggcagccgcaatcacctgccagacggttaaacgtaacgtggtcataacgtcccctcagaaaagacactgacggagacgccataccggagaatatcccgcacttcatggcactgctgataacaggaggcaaccccatgcagtgacaataaatgtgccttgtgccacaacgcacgcgccgtcggagtattctgccagctctgctcaagcatcgctgcctgacataaccgctgctgttgctgttccaatgacaggcgttctgacgtcagtgtgaccggctgcgcccagataatctcttcatcaaaccggccaccgagcacttttctgtcctgtgcgtcaaaaatcatgacggtcagcggaaaaaaagtccccgaaacctgagcagataacctctccggcaccggccagtcacccagtagatggatcaccttcagccgctgcaccacttccgtgacggtggcggcttcgcacatcatcagggtttccggctgcaatgactgtggtgctttcgggtgttgcctcaggccgctgacctgagcggtaaacagctcttcacgtaatgcggtaccggtatcatccggtgccggtatcatccggtgccggtaaaaaaatggggttcatggtgttgtcccttgatttcacgttaaataaagaaaacacccgcccgataccgggaaggtgttttcgcttccccggtcaggcgctgaagaaaagcgttaacagcctcatgggctgataacgtcagtgatgattatttttgtcagggataagtgacggactgataacatcctctctgggtttcagtgtcatgaccgaggctatcaggccgctttccggatgctgttgtgcatacgcctgcaatgcgcagaaccggtacacctcctcattcggggtctccagcaccgcgatacgggctgatacgatggccgtgaccgccagcccgaaggcatcggctgaaagcgtgaccgtcagctgcgtatccggcaggtaaacggaatacgtttccgcccgtatcggcaccatataagtcagcgattcagacacctgtcggcttgtccactgttcaggctgataatcgccgcataacgttgatgcggtattcgccagcaggaaccccagaaacaaccgttccagcggggttttgtcgggaaacacgaccgacagcgcaagactgtccagcataatcagttcattatttggcattatattctccctttaagcccaaagccgcccgaatgcactgagcctggggatgttgcagcgcatattcccgcagggcacaaaaccgttcagcatatccgtccaattttaacaaggtcgtcagataccccagtacgctcagggtcaccatcagcccgaaagcctcggcagagacctcacctttaaagtccgttggctcaaccctgaccacagcgggttctggtcgtaccggcacgatataagcgatagtgtctgatactttccggtactgccactgatcacagcggtcatcgtcacacagcacggcggcggctttaatgaatgtgtgctccagcagcatcagctccaacgaaccggtgtgcggaaaaatttcagcaaagggggcgtgttcagaggcgggcacaatggccggcggtgtattttgttgcatggtattcctcctgataaaacaacggggaacacctgacccaatgggaaacgtgttccccgttgggtgactggcctgttggccatcatggattaagtaaccttcatcgccaaatgattgacgatatctgcttccaaaggtgcgcagatgtaccacacatcggtgtactcccttgcaggctacaggagtgttgctgtcgctgcccgaaggtgatcctcacaagcgaccggatcattgataagacttatcacgctaataaatggaaatcataaggtcaatgggtaattcattttccgggacagaaaataacatcagaatatcgataccctcatttttcctcactattttggcaatacacctgccggatatagcgccccggattgctgggcaaaatggtatcgcatgctgtgcggcactggcttacccaccagtccggcactgctgaccacgtataaatacggatacgctttttataacgaaacacgttccaggtagtgctccagacagccccctttattgggggctgggatatttaaaatcgtttacacaagaaaaaaggccccgaaagctcgttgaaaatgtaaagatctttatcaaccgacgtaatatttaggtaagaggataacggtactcttcccaatatggggaatatcgtctcaaccgtggatgggatattgtcattagctcgcaattttacatttataatttggaatgtgtatatataatccttatcaaaatcagtataattaacattcacttcccgatccattatgtaatttttattaccgattgacagtatccctttctgtgtcaaaaaaccggtcccattatcatataaaaataaaaaaaatttttcatttaaattagccaaatcagtgttattcacttttctacgtgaagttaactcacctgtacatcgaatctcgatgttattttttttattgctcatattgataattttaaataatactattaataaaataatggaaagcaatgaaagtgcaatatataaccaatgattttttttcataaattgacaccaaggttgtttaatatgcttctacaatctttaggtttgttattgtcgtccaggccacatatgccgataaaactaatttgtgtgtcctgactgccactacgtgtttttttgtagtaaatattccccttcgcgaggtcacaattaatgatttctttgttgatatcttgtttggctatatcaatataattttcacccacatctattggcagatctcccaatgcataaacgtcacattttccaacgctatacagaaatgttgttttttcatggcgtacgtttaggtgtttgaatttaataaaagcttcataagaagcgtagccacagaggaaaacgaaggtcatgcatataacgaatttttttatttgttgttttttttgtcttatgaaaatagttttatcagtggactgttttaattgcacctcactttcatcaataggaaaagtattgttttcactctgtttaatgactggctctacagcaccctcaaaacgaaaaccgactttaggaatggtgatgataatctttggatcccttcccaaggattcaaatgattttcgaatctcgcttacagcgacattgaggctattgtttgaacgtgtaaaaccataatcctcccatacccttttcaataaatcttctctatgaagagtctcattgctgttagtgatcatctcaagcagcagtcgcgccgcttggtttgatagtgtgatttcatgattgctatcgttgagtaatgacagtttcctgtctgcaggtgagtatatgatggtaaactttataacgtatttcaatgacttaattccaaacagattaagatttttcttaaaaaaatagatttatagattttccatttgcccgtcaatgattttatttaaaaggagtgaatgatctatcccctgtttttaaagaggtattaactgctgctttatgtgttttttttattatcaccggatattaattattataatatgtattttatcggaataaaaatctttttaatgaaataaataagtataatgttttgtttgtttttttattctctatcattgtcgccgttgtcacagaggttctctgctcgactagatgcgcagtgtgacacgggaaaacggggctcaggttacaagaggtaagtgttgagttcttcattcatcgtaagatgtgcttatggagtggctcacacttacaatctgaacggtacggcgctatgcaccaaaaaatagattaaaccgcaagcaatggattaaaaaacggccactaactatcggattttattcttagcagtcatattatttttatgtactatatatatcgtgtagaggatgcgagaaacatataatgttctcattatatcagatcctcaatattttcgtttaaagaccagtagtaataacccaagcaaggaccgttctggatgggaatcatttaatgaggtggtgagagcataaaatcagtggagcacttatgctgtaataacttatgtaaatagtgatccgtttcttcacttaattttattatcccagatacccatgcttaattcgggctcttaaataaccctgagcttagcgatgacttcattgatcgtggattctacgaacaatgaataaattggttctccgtatcgggacattccccataattgaggatctattaccctgttatttttaatgtagatatacatcttatccatctgttttaacagaaacttataattttcatactgaagggcataataagtgccccacagatttttatgctctcataggaaagtagtttacaaaatattgtctacccaactttctgagacatcttttatataataattgaggttattatgtacagcacggctgtgttactaaacaaaatcagtcccactcgcgacggtctgacgatgactctcgcagaccttcagcacctttccttcagtgaactgagaaaaacatttgatgaccaactcagttggggtgaaagccattatctctatcgtgaagccgttgaacaaaaaaaacgtcatcgtctgctggaagcccgtattttcacctgtgccaatcctcaattatccggcgccatacgccggggcattgaacaagacgatgcttcacgcagttatgataaaatgtttggctcccgctcttcttcctttgtcaatccgggctccgtggcctccatgttctcgccggccggttacctcacggagttgtaccgcgaggcgaaggatctgcatttcacaagctctgcttatcaccttgataatcgccgcccggatctggctgacctgacgctgagtcagaataacatggactcggaaatttccacccttgcactgtctaacgaactgttgctggcgcatattacccgccagaccggaggtgactcagacgccttgatggagatcctgtcgacttaccgcaaggccgttgacacaccttaccatcagccttatgagactgttcgtcaggtcattatggcgcatgacagtaccctgtcagcattgtcccgtaacccggaagtcatggcgcaggcagaaggcgcttcattactggcgattcaggccaatatctcgccggaactttatcacgtattgaccgaagagattacggaggagaacgctgacactttatttgcgaaaaacttcagtgaaaatatcacgcctgagaattttgcatcacaggcatggatagccaagcattatggccttgaactttctgacgtgcaaaaataccttgggattttgcaaaacggctattctgacaacacctctgtttatgttgataatatttcaacggggctggtagcagacgatgagggtaaactcgacgcttacaagataacccgaattcctggcggagattatgcaaagcacttgaacttttgggatctgctctataaaggtgatagcgatttcgttatcagggccaatttcaaaaaaagtagtggtggtctcacaatacgtaaaagtggagtgggaacgaccaatgatagcaaagttataggtactatctctgcaccaaccgatgcgaatacagtttatcaaagtgaaatattatcaccgcttaccgttgatgatttaaaaaatggggcgacaatatttgcttataatcgtggtggcaataaaaatattgagggaactgctgtctttaccttcgaaagttaccctctgagcatttttgctctcaaactgaataaagccattcgcttatgtctggctagtgagttatcgccgaatgaattacaaactatcgtactcagtgataatgcacagggcatcatcaacaactcggttctgaccaaagtcttctacacgctattctacagtacccgttatgccctgagcgctgatgatgcgcaggtactgaacggatcggtcatcaatcagtatgctgacgacgatagcgtcagtcactttaaccgtatatttaatacgccaccgctgaaagggaaaatctttgaagccgacggcaatactgtcagcattgatccgaatgaggagccagcgacctttgcctgttcagccctgatacgtgggttgggaattaacagcggtgagctgtatcagctaggcagattggcgggggtactggatacaaaaaataacatcacgctttctgtctccgttatctcttccctttatcgtctgaaattactggctcatacccatcagctcacggtcaatgaactgtgtatgctttatggcttttcgccgtttaggggcaaagcaacggcttctctgtcttccggggaactggcgcagctggttatctggctgtatcaggtgacgcagtggctaaccgaagcggcaataaccactgaagaactttggttattatgtacacccgaatttagcggaaatatttcaccggaaatcaataacctgcttaacactctccgaccccgtattagtgaagacatggcgcagggtggcgaccgggagctccaggctgaaattcttgcgccgtttattgctgcaacactgcatctggcgtcaccggatatggcgcgttatatcctgttatggacagataatttgcgaccgggcggcctgaatatcgccggatttatgacgcgggtgctgaaagagacgctgagtcctgatgaaactatccaactggtgcagttctgccatgtgatggctcagttgtcgctttccgtgcagacgttgcgtctcagtgaagccgagctgtccgtactggtcatttccggtttcacggtactgggtgtgagaagtcaacccgccggacagcacaatatcgataccctgttctcactctaccgattccaccagtggattaacgcactgggtaacctcagctctgacacgctggatatgctgcgccagcaaacgctgacggcagacagactggcctcggtgatgggtctggacatcagtatggtgacacaggccatagcctgtgctgacgtgagcagtcttcaaagctggcagaatatcaacgccgtgctgcaatggatggatgtggcctcagaattgcacaccatgccatcggttatccgtaggctggtcaatatccgctacgtgactgtgccgaacaaagccgagtcggatctgccttcctgggatgaatggcagaccctggcagaaaatatggaagccgggctcagtacacaacaggctcaggcactggcagatcataccgcagagcgcctgagtagtgtgctgtgccattggtttctggccaatatccagcctgaagggatattcctgcaaagccgggatgacctgtacagctacttcctgattgataatcaggtctcttctgccataaaaactacccgactggcggaagcgattgccggtattcagctctacatcaaccgggcgctgaaccggatagaatcgaatgcccgtgccgatgtgtcaacccgtcagttctttaccgactgggcgatgaataaccgttacagcacctggggtggggtgtcgcggctggtttattatccggaaaactacattgacccgacccagcgtatcgggcagacccgaatgatggatgagctgctggaaaatatcagccagagcaagctcagccgggacacggtggaggaggcctttaaaacctacctgacccgctttgaaaccgtggcggacctgaaagtggtcagcgcctatcacgataacgtcaacagtgactccgggctgatctggtttgtcgggcaaacacgggaaaacctgccggattactactggcgtaacgtggatatctcacgcaggcaggcaggtaaactggctgccaatgcctggaaagagtggacgaagattgatacggcggtcaccccatacaaagatgtaatacgtccggtggtgttcaaagagcgtttgcaccttatctgggtggaaaaagaggaagtggcagaaaacggcactgacccggtgaaaacctctgaccgttttaccctgaaactggcgtttctgcgccatgatggtagttggagtgctccctggtcttacgatattacgacgcaggtgaaggcggtcactgacgataagcctgacgctgaacggttggggctggcggcatcaggttttcagggcgaagacaccctgctggtgtttgtgtacaaaaccggggagagttacccagattttggcggtagcaataaaaatgtggcaggaatggtcatttacggcgatggctccctgaaacagatggatagtacggcactaagccgctacagcccgctgaaaaatacctttgataccattaacacgaaagataataatttggtaagaaaggccagctatcgtttcgctcaggattttgaggtacccacctcattgaacatgggatcagcccaagacgacaggcatctggtcgtgatagagaacgcggctatcccggagataaccagccaatcttccagtgaaagctttactattacgctgcagaatgcgaccttcaccgtccggtatgacggcagtggcaatgcactcagaagcaaacaaatccgcgccatgaaactcgggggactcgggggtttacctggtgatgactttatactcgccaattcagcccgctatgctggcggcgtcagagacctcggcgggccaatcgcgatttataacaaaacgaaaaactatatcatatcggtacaagactcttatgagccctcccttcatctcagatatctgcgattgagccccattaatgattctggcccaattctaatcagccccgcaccttcttatccgaaagatggaacaaatgtaattgcttatcttggcggcgacaggtcaagtgactttaaaaagtgttactatgcttttgatcgtggaaacaaaaagattgggcccttccaagactggtcatcgtattattcatacggcggctggctggaggttggctcgggggctaaccctgcggggacccagattaccgtcgtggccggcagcaaaccctaccattttaccgccgagaatcatgcggttagtttgccgccaaacagctttgagggcatgcagtataccttcaagcccctggtcatcgatgccgctgggctggtttatctcaataacgcggcgccagtggatatcacctttgaagtggaagggatggggaaaatcagccagaccctgaccgtgagaaaacttgactacggtcaggagaatatcctctgtctgcaagagaccgacaccggtgtgcagtatatgcagctcggagtttatcgcatccgcctcaataccctgctggcacctaaactggtgtccagagcgaataccggcattgataccatcctgaccatggcgacgcagcagttgccggagccgcagttaggcaaaggtttctacgccaccttcaccctgccaccttataatccggcaacgcatggtaccagtcgggcgttcaagcttaaccttaaacatgttgttgatgataacgttcatatcatctactcaggactgctgcaagataccgagcttgcagttcggctctttattcctctggatgatacaccgctttatgagaaattcattgccaaggtgtttttaaccacccagaagaaccccaatgatgttccatgggcaggaccacactttacggatgatagcggtaaaataggtatccatggcagttcgaatgtcagtatgttcactggtgtacaaccccataacggcacaactaccgaaccgctggactttaacagtgcctgcgccctctattactgggaactgttctattacacgccgatgatgtgcttccagcgcctgctgcaggaaaaacagttcgacgacgccaccaaatggatgaactacgtctacaacccggcgggctatatcgttcacggggaaatcgcgccctggatctggaactgccggccgctggaagagactacctcctggcatgccaatccgctggatgccattgatccggatgctgtcgcccaaaatgacccgacgcactacaaagtggccacctttatgcgcctactggaccagctcataacgcgcggcgatatggcttatcgcgaactgacccgcgatgcactgaatgaagccaaaatgtggtatgtgcgcactctggaattgctcggtgacgaaccggaagattacggcagcagccagtgggcggcaccgtccctttccatggcagccagccagactgtacaggcagcctatcagcaggatcttacagcgctggacagtggagaggtttccatgcagccccgcaccgctaactcgctggtcggtttgttcctgccggagtataacccggcgctcactgattactggaaaaccctgcgtctgcgtctgttcaacctgcgcaacaatctatccattgacgggcagccgttatcgctggcgatttacgccgaacccaccgatccgcaagcgctgctcaccagcatggtccaggcgtctcagggcggcagtgtattaccgacaggcaccttgtcgctatatcgcttcccggtgatgctggagcgggcccgcaatctgggggcgcaattgacccagttcggggcttccctgctcagtatggcagagcatgatgatgccgatgaactcaccacactgttacttcagcagggcatggaactgtccacacagagcatccgtattcagcaacggacagtcgatgaagtggatgccgatatcactgtattggcagagagccggcgcagtgcgcagaaccgtctggagaaataccagcagctgtatgacgaagacatcaaccacggagagcagcgggccatgtcgctgtttgatgcggcggcaggtcaatccctggccgggcaggtgctcacagcggcagaaggggtggctgacctggtgccaaacgtgttcggctttgcctgcgggggaagtcgttgggggtcagcgctgcgcgccgcggcgtccgtaatatctctttctgcgacggcttctcagtattccgcggaaaaaatcagccgttcggagacctatcgccgccgtcgtcaggagtgggaaattcagcgtgataacgcggatggtgaaatcaggcagatggatgcccagcttgaagccctgaaaatccgtcgcgaagcggcacagatgcaggtggaatatcaggagacccagcaggcacagacccaaacccaactggagctgttacagcgtaaattcaccaataaagcactctacagctggatgcgcggaaaactgagcgccatctactaccaattctttgacctgacccagtccttctgcctgatggcgcaggaagcgctgcgccgcgaactgagtgacaacggcgtgacctttatccgtggcggtgcctggaacggtactactgcgggtttgatggcgggtgaaacgttgctgctgaatctggcagaaatggagaaagcctggctggagcgtgatgagcgggcattagaagtcacccgcaccgtgtcgctggtgcaggtgtaccaggctctgtcatcagacagcttcagcttgacggagaaactcacccagtttcttagtgaaggcaaaggcagcgcaggcacttccgggaatgaactgaaactcagcagcggccagattgccgcctcggtacggctgtccgacctgaatatttttggtgattaccccgaaagcctcggtcgcacccgtcagttgaagcaggtgagtgtcactttgccggcgctggtcggcccgtatgaagatatccgggcggtactgaactatggtggcagcgtgatgatgccgcgcggttgcagcgccattgccctctcccacgggatgaatgacagcgggcaatttgtgctggactttaacgatgcgcgctacctgccgtttgaaggtattcctgtggatgacagcggtagtctgacgctgagtttcccggatgcgaccgaccggcagaaagagatattgcagagcctgagcgacattattctgcatatccgttacaccatccgttcttaatccagatatttttaaatacaggccccattggggtctgtaaggaattgttatatgcaaaatacagcacctttgcagattggaaccccgtcactgcccaaaggcggcggtacactccgtggcatgggggaaacctttaccgggggcggccctgatgggatggctacgctttcattaccgctgccgatttccagcgggcgcggcaccgcccctgcgctgtctctcacctacagcagcggcagcggtaatggcgcttttggcatgggatggcactgtgccaccctggctgtcagcctgcggacttcacacggggtgccgcgttatgagggcaacgatacttttttgagtccgatgggcgacgtaatgcaggttgccccaaacgaacagggcaagccggatatccgtaccacgaaccagttgcagggcgtcacgttagatgagagctggcaggtgacccgttatcagcctcgcatcatccatgatttcagccggctggaatactggcagccggaacagggcaatacacaaaaacccttctgggtgatgttcagccttgagggtcaagtgcatctctttggcaaaaatgcccatgcccggatggctaatccggctgatgataatcagattgctcagtggctactcgaagagaccgtgacgcccaccggtgagcatgtttactaccaatactgtgccgaagatgacgcgggctgcgatgagcctgaaaaaggacagcacccgttatccggtgcacagcgctatttgatgcaggttcactacggcaatatcacgccacaggcgagcctgtttgccctggataaggcgctgcctgctaatgaccaatggctgttccatctggtgtttgattacggcgaacgggcaggctcgctgtatgacgtgcctgcgtttcaggcaacgtctggaaactggcctgttcgcccagactgtttttctcgtttcgaatacggttttgaaatgcgtacccgccgtttgtgccgacaggtactgatgttccatcggttaaaagcgttagccggcgaagacactgcccctgaaacaccggctttggtctcccgtctgatgctggcgtatgacttgaaccattgtgtcagtactttggtttcggcccgtcaggtggcccatgaaaatgacggggcgcccgtcaccctgccgccgctggagctggattatcaacggctggatacggcgtcgttgccggtctggcagcccatgccgcagttggacaaattaaatcacctacagccgtatcagttcgtggatctgtatggcgaaggcttaccgggcatcctttatcaggacgctcctcacgcgtggtggtatcgctctcctatacgtgacaccacggcagaagcacgcgataccgtggcctatggggagataaaaccgctgccgcagatccccgcccagcagaataatacctcactgatggacatcaacggggatggcaagctggattgggtcgtcacctctgccggagtcaatggctatcacacgatggcgccaaacggacagtggtctccttttgtcccgttatctgctttgccggtcgagtattttcacccgcaggcacaactggccgacctgactggcgcgggactggctgatctggtcatgattgggccacgcagtgtacgcctgtatgctaaccaaccaacgggctggaaaaaaggcaacaccgttatccagtccgacggcatgacattaccgatccccggtgcagatgcgcgtaaactggtggcctttgccgatatgctgggttccggccagcaacatctggtggagatttccgctgacggcgtgacgtgctggcctaatctcggacacggccgttttggacaccccatcagactggccggattgacggtttcagccaaaaactttaatcccgatcaggtgtatctggccgatattgacggctccggcacgaccgacattctctatgtccacagcacctatctggagctgtttatgaatgaaagtggcaatcaatttgcggcaccggtgcgcatcaatctgcctgagcatgtccggtttgaccgggcatgtcagttacacatcgctgatacgcagggattgggcgtatccagcattattctgactgttccccatatgactgtgcggcactggcggctggatatgactcaacacaaacccgggttgctgaataccatcaacaacaatatgggcgcggagaccaccctgttttaccgcagttcggcgcagttctggctggatgaaaaacaccaggccgaaaacgtgggacgtgctgtaaccagttatctgccattccctgttcatgtcttgtggcgtgccaaagtcttggatgaaatcacgggtaaccggctgacttcagagcaggattatgcccatggtgcctgggatggccgggagcgtgagttccggggatttggccgggtcagccagaaagataccgacaagctggcacaggcaaccgattcgtcagttaccgatcccctgtcgcccgccatcacgatcagctggtttgccaccggggttcctaccgttgatgcccggctggcggaggaattctggcaaggcgacaaacaggctttcccgccctttacctgccgttttacgcattttgacctggataaagaacaggatgttactctcgttccctcgacggaagaggcttactggctgcaccgggcgttgcaaggccaaccgttacacagtgaggtctatggcgatgatggcaccgcgcaggcgggtatcccctataccgttatggacagccgaccccaggttcggcttctgacggggttgccgggtaattcatcgacagtctggccgagtgtgattgaacagagaacctggcagtacgaacagattgccgatgatccgcaatgccatcagcaggtggtgctgaacagtgaccgctacggtttcccacgggagactgtcgacattgcttatccccgccgtcctaagcccgctgtctcgccttacccggatacgctgccggcgacgttatttgacagcagctatgatgagcagcaacagcagctgcggctcacccggcaacggcagcgttaccatcatctggctgacacggaatatcaggtgctgggactgcctgatgtcgtgcgaagcgatgcctgggcctatccggcagagcgcgtgccccgtgaaggtttcaccctggaggacttgctggcagagaacagtttgatagcaccgggcacgccactgacctatgtggggcatcaacgcgtggcttataccggaacgaccggaaccgaagaaaaaccgacccgacaggcgctggtggcttataccgaaaccgcggtttttgacgagttggccttgcaggcctttaatggcgcattgagtcctgaagccctggaaaagaaattaatcgagtcgggttatctgcatgtttcacgcccgctcaatacgggggcagaatcggcggtctgggtcgcccgtcagggatataccgattacggcggggctgaggcgttttaccgtccgttggctcagcggacgacggtgcaaattgggaaaaacaccctccattgggatacccattactgtgccgtcatccgtatgcaggatgcggcgggtctgtacacggatgccgcctatgattaccgcttcctgacccccgttcagataaccgatgccaatgacaatcagcaacatatcacgctgaccgcgctggggcaggtgtcatccggccggttctggggtacagaggcaggcactgcgcagggttataccccgcctgaagaccgcccatttacgccgccgtcctcagtggaggaagccctcgacttgaaaccggatcttccggtcgccaactgcagggtctatgcgccgctgagttggatgccgttggcgcacacctgtcaggaatatatagccggctttacggggcaggcactgcttgatgcgggtgtggtgacggaagataagcgggtatgtgcgctgggtttccgtcgctgggtgcaacgtcagggcattgtgctgaatgggcaggcattggccgattcacgggaacccgtccatgtcctgacgctggccactgaccgttatgacacggatcccgatcagcaactgcgcaagagcgtcacttacagcgacggtttcgggcgtttattgcaaagtgcaatctaccatgcgccgggagaagcctggcaacgcgcggcagatggcagcctgatcacggatgagaaaggggcgcctctcgtagcccataccccaacccgctgggcggtctcaggccggacagagtatgacggtaaagggcaacccgtccgaacctaccagccctttttcctgaatgcctggcagtacctcagtgatgacagtgcccggcaggatttatatgccgatacacactgttatgacccactaggccgggaataccaggtgagaaccgccaaggggtatttgcgtcaaaacctgctgaccccctggtttgtggtgaatgaggatgaaaacgacacgctctcttaattaacacgataacgttaaataatcacaccttcctgccagatacgggggaaggttaactactctatcaaggaaagggcttatgactgtaaacagaggcgataacctgcatcaaaaaacgccggaagtgacggttctggataaccgggggttgaccgttcgcgagctccgttatcaccgccacccaaatacccccatcaccaccgatgaacggatcacccgccatcggtttaccctcgccggtcagttggcgcacagcattgacccgcgcctgtttgacttacagcaggcggataatacaatcaatcctaatatggtttatgagacggcactgacaggcgaagtggtgcgcataaggagtgtcgatgcgggtaataccctgatgctgaatgatattaccggccggcctgtgctggccatcaatgcaaccggggtcacccgtacatggcaatatgaagatgatactttacccggacgcccgctcagtatcaccgaacagcctgctgacgaagtagcccgtatcacagagcgttttgtctgggcagggaacagtgaggcggagaagaacagcaacctggccggacagtgtgtgcgtcactatgacactgccggactgaaccagacggacagtattgcgcttaacggaataccgctgtccgtcactcgccgactactgccggacggtacggacgcagactggcagggaaacaatgaatccgcctggaacgaccggctggcaccggaaagcttcaccaccctgagcacggcggatgccaccggtgcggtactgaccaccaccgatgcggccggtaacctgcagcgactggcgtatgacgtggcaggcctgctgactggcagctggctgcggcttgcgggcgggacagagcaggtcatcgtgaagtccctggcgtattccgccgcgggtcagaaactacgcgaagcgcacggcaacggcgtagtgaccacctacacctacgaaccggagacccagcgccttgttggcataaaaaccgaacgcccaccgggacatgcacagggggcgaaggtgttacaggacttgcgttatgagtacgacccggtgggcaacgtggtgaaagtggcgaacgatgcggaggttacccgcttctggcgcaaccagaaagtggtaccggagaacacgtatacttacgatagcctgtaccaactggtttccgctaccgggcgtgaaatggctaatattggccaacagagttctctgttaccccccccttccctcattgatagcagtacctacagcaactattcccgcacctataattatgaccgtggggacaatctgacgcagatacgtcacagtgccccggccaacgacaacagttataccaccaagatgacggtctcagatcgcagcaaccgggcggtgctaagtacgctgacggaaaacccagcggaagtggatgcgctgttcaccacaggtgggcagcagaaccagctgctgccgggacagagcctcgtctggacgccgcgcggtgagctgctgaaagtggcacccgtggtgcgtgacgggcaggtttccgaccaggaatcctatcggtatgatgcggacagtcagcgcatcatcaaaacccacgttcagcagacggctaacagctcgcaaacgcagagcacgttgtatctgtcaggactggagcggcacaccacaacaaatggcacgacggtgaaagaggtgctacacgttatcacgataggagaagcaggccgtgcgcaggtgcgggtactgcactggaagaacggaaaaccggatagcatcagtaacgaccagatacgctacagctacgacaacctcattggtagcagcggcctagaggtggacggagacgggcaaattatcagtatggaagagtactacccgtacggtggcactgcggtgtggacggcgaggaaccagactgaagcgggttataaaactgttcgttactcgggtaaggagcgggatgctacggggctctattattatggctaccggtattatcaaccgtgggcggggcgctggttgagcgcagatccggctgggacggtggacgggctgaatctgttcaggatggtcaggaataatccagtatcagggtatgacaatgtagggcttgtgtggactcctgtaaccaaggctgtaggctccggaatattgggtgcggctacgctggggtacgaagcgtataaacactcaaaatcaaaaaatgaacctgtccaattatcatcaaatacattaggcaataataaaatccatgaatttcacaaggcggtcactgataaaaataataaattctcagtgactgaagaggtaaaagaaaatttatcaggtcgaggaaaggttataaaaaactttcttaccaaaggagaagttcctgctcatgattcaattatgaatcaaaaagagaatttaataacaatagcaaaatacagtcaaaacggggacgtgagtaagttggataaaggcaagttagccattgcctctgtatcagacgcaagtaataatttgccaataagaatttatcaggcttataaaggctttcgtacagccacatcagtgactcctgaaggggtggatgaggtgatggaaagtgtggcaacagcgaaggataacgtaaaaagcaccttgaatgttgggattggcgttggcgtcattggaaattcgctattgtcagtggcaaaagtattcgttcctggagctgctattcctattaccgccggtcaggcactatgggcagtatcatccgtcggaaaaactgtaaaccaggtgaataaagcagtaaaagaaaatattgaaaaatcccctatatctcatgaatttaaagaggaattatttaggcagatgggaaagccaacaaataaagatgggtaattcctcttaatcgaccctgtttacgattttatgtaatcgcgatttcctattagacgtgaccgtttaggcggtcaccgaattcaatcataaaacgaaccatcgccagacgccaattctggatcggcattgtccatttcttagaggctgtctgaatcgccagccaaacgtcagcgtatggggaattataccttgccctctgccattttccatggccgcagtttttctcaatccggagttggctggcataactcatccaggccagtcatgacataatcgaaggggatcagcccattggcttttgctgtttcaatgacgctatagaggatctcgctcgcctgtgtaccacttggagtatgactgaacagccacgcatttcgcccgatgacaaacggtttgatcgctctttccgtccggttattgtcaatcgacagccgtccatcctcccgtacgcttaccgatctggttggcgagctgcaccagtaaagcgtccacagttcaaaagcctgaccgactccatcgacacgccatcaggccggtttttcttctacgtcatggccagcctcaccgaaatggagcgtgagctgatcgtcgagcgcacccgtgccgggctggatgtcgcccgtcagcttagccgcaagcccaagatgacagacagcaagatcgagtcggccaagaaactgctgaccagcggtgttccacccaaggacgtcgccaagaaccttggcgtatcagttcctacgctgtaccgatgggtgccggcatcaacgcacacttagcgaatgaaagggactttccctcgattgggttactgtattgattttccgtgccatcatggggagtaaccaaaatttgacactcaatttaattgaggatctaaaatatcgattactttagctaagacttcatcaacgacattaggttcagcttgtgctgaatagctagctttgcgttcattcaaatcaagtgaacgaatctggtagcaaagcgcaacactggtaatttttccggtatcgatacttgagccatctagatatacggtaatagcttcagaacgtgctagccctccaccactggtaattggaacacaaagtgcagtgtctaacttttgattcagtgcaaattcagagataaccagatagtaatggacccctttaaactcctgccgctaacggggtcgccgttagcatgccagatttcacctttgcttgggacgctccttctacgcaccattaaatcacctcattaccaacaggatgagaatttagatcatcgcctgttgcttcgttgaaagtccgcacttctgtttcatcaatgccttgcaacaactcagaaagagacttcctgcctctggctattctacctgttggtttgatgcttattccgtcgcctgacgtttttacatccaattttgtacctactgaccaccccgttgctgttgcaacgtcactagggattgtgacaaccactgccccgccctgttgacgtaaacgtgttattgccataataacctccaatcaatgtgtaactttatctcacaaagtcacactttttgctttaaataaggctcccaacagaatgaggaaaaaatagtacactaaacattggtgtcagtttgaactatagctaaatcatattaatatgacataatatctaactctaagataacaaggcataaaatgagatgggctacagcttagattttcgaaagcgagtactggcatacaaagacaagcattcgttgactttcgaacaaacgagtgcccattttgaaatctccatgcgtaccttgttccggtggtgcaataaaatagaaccttgcatgacccgcgataaacccgccacgaaaatccctgatgaggtactcattgcggatgtccaaaattttcctgatgactatcaatgggaaagagcaaaacgtttaggtgtttcacaatcggctattcattacgccttgaaacggctgaatatcaccccgaaaaaaaacgctccaacaccctcgcgctgatcctcaatctcgtcaggcatttatcgagcacatcagcgatgatgaacagactggcagaccccttgtttatttggatgaaagtggttttgctcaatcgatgccacgtaaacaggggtattcggaaaaagggttacgctgttttggtacgcatgactggcacgcaaaaggccgtctcaacgtcattggcgccattctcgaaaataccttcgtcaccttaagcttatttaccgggaatattaatgccgatgtttcttatgcgtggatgacgcaagatttgctgccaaagcttccacacggagcagtgatagtgatggataatgcgcctttccataaacggaatgacacgacacaagcgatagcagacagcagatgtcaactggaatggcttcccgcttataatccggatttaaaccctatagaacacaaatggggcggagcaaaagcgataaggaggcaaaaaagatgttcagttgatgagttgtttacggagcatattgaataggtcaggttatgttgattctgctatatgtagtgacctacaatcgaaaactgttgttgattgtaggccactacagatataggcttgttttagttcacctaggtgtaagtggtgatgtagaatgctacatactttattttttgaggtttataacatgacattgaaatatcaattagctgacttacagaaaaaagccaaagaaagaactgtaaaaacccagaacatagagtatgacttagagacattagtaaaaaaaatagaccgtaaaacaataaagcttaatcctgattatcagcgcagacatcgctggacaacggaggcttcatctcggctaatagaaagcctaatacttaacataccggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacctaagaaccgctatttcagaatcacgtaaattcagactcggctttttaccaaaatccgctgtaaaccctcgatagggcgggaagcagtcatagagtaacagtcggatatatcaacctatggaagatttcccaatgatgaaaaaatttgtaatcgtatgaatgaggtgcttaattttctgtacatcttgccaccagccatgattaatacgatcatcactggtcgtgcctggtgagaacggataatgaaacgttctaccatactttcttgattgcatatccataatgctttgactcttttaaaaaattatcctaataaaagcgtatttatacctttacagattaatgttcatcttaaaatcgatgaaagagctcaaaaattggtattacattttctttattcctgattttaatcttttaatatgtggaatattaatactgttattgttttaatgatttattttttagaaaaattaattctgtatggtaacaaaaaccccctgcctaatactacaacaagggattatagttatatattcaatatatattcaagggaataaaaattatcaactaaccgccgcaaacgcctcagcaattttctgtacgttttggtgattcacacccgccatacaaatacgaccagagattaccagatagacgccaaattcttcacgcaagcgatcaacctgttcctgactgaatccggtataactgaacataccacgctgtttcaacaagtgatcaaaatttttctctggcagcgcacttttcagagcattaaccaaaacagttcgcatttccttaatacgcaaacgcatctgctcaacttctttcaaccacagggcttttaattcaggatcgctcaataccctggcaactacctgcgcaccaaaattaggtgggctggaataaatacggcgcacactggctttcaattgccctaagacacattcacctgcttttgcatcatcacaaacgactgacaatccaccaacgcgctcaccatacagggagaaaatttttgagaatgaattacagaccagacatggcagttccgcattcgccatcgcacggatagcgtaagcatcttcttctacaccatccgcaaatccctgataggcaatatcaaggaatggaatcaactctcgctcttttgcaacctgaaccacttgatcccactggtcattggttaaatcagaaccggttggattatgacagcaaggatgcatcaaaataatactttttgccggcagttggttgaatgttgccaacattttatcgaattttacccctttagttttatcatcaaaataagggtaataattcacgttgatccctgctccagcaaaaatcgatgcatggttttcccatgtcggatcacagcaccacacttcagaatcagggaaataacggtgtaaaaagtcagcgccgacctttaacgcaccagagcccccaacggtttggatcgttgcaatgcgcttctgccctaataaaggatgatctttgccaaacaacaattcctgaattgccgatcgataggcaagcaatccttccatcgggagataaagagaagcagactgcggcaaagcactcatttgttcttctgcggttgcaacagcctgcaattggggtgttataccctgttcatcgtaatacaggccgatgctcaggttgattttttctgcacggggatcttttttaaaggcttccatcaacgaaagaataggatcacctgcataagcatcaatattctggaacactgcgtatactccctgttactgggttatatataccctttatctgtccgattgcagctttgtcggctgcaacgagaaatctattgggtataaggacactgtaacagacaatataatttaacgggttattcgtctagatattccatcacaacacgtgaagtcaattttgtgatcagttcataagcactgataccggtgtgttccgcaattttttcaacaggcaggatattcccccaaagggtaacttcatccccgactttgtcataacattctggccccaaatcgacggtaatcatatccattgagacccgaccaaccaaaggaaccttgcgcccattaatcaatacaggcgtacccgatggcgcactacgcggataaccatcaccatatcccactgccacaacaccaagagttgtatctcgttcactgatccaagtgccaccgtaaccaaccgattcgtctgacttatgtttacgcacggcaattaagctggatttcaatgtcatcgcagggatcaagttgaagtcagcagcagttttatctgctatcggcgatgcaccgtacatcataatacccggacgaacccaatccagatgtgcctgtggccacaataaaatgccacccgatgcagcgatggatttttcacccgatttatctgcgataaatgccataaagcgatcaatttgctggggggttgtatccaccgtcagctcatctgcacggctaaaatggctgacgatattaaccggctgctcaacgttatggcagcaactcaagcgttgataaaattcttccgcttcatcaatacgaacgcccagacggtgcattcccgtatccagtttcatccacactttaatgggatgggataagttcgcctgttccagtgcttctagctgttcaatgctgtggactacggtttctatatggttgacgaccagaacgggcaaatctgccgcttcaaaaaaaccttccagtaataggataggcttgacgatcccaccattacgcagggccagtgcttctccaatgcgagcgacaccgaaactatcagcatcttccattgtgtacgctacttctaaaaaaccatgtccataggcgtttgctttcaccactgcaaccagtttgctgtcaggagcttttactctgacctgttgcagattgtgtcgcagagcgcggcggtcaataacagcagttgccgctttcattttgtcccctcgttactattttccggtcagttggttttggtaagtacgattattcgtcgctatagcttggtcctacgtaattatcgaaccgtgaccattggccgttaaacgtcagccttatcctaccaatagggccgttacgctgcttaccaaggatgatctctgccacacctttcagttcgctgttatcgtgataaacctcgtcacgatagataaacatgatcaagtcggcatcctgctcgatagagccggattcacgcaggtctgagttaaccggacgtttatcagcacgttgctccaagccgcggttaagctgagagagtgccacaactggcacttgaagctcttttgccaaggctttcagggagcgggatatttccgcaatttccagtgtacggttgtcagatagggaaggaacccgcatcaattgcaggtagtcgatcataatcaagctgagtccgccatgttcgcggaaaacccgtcgggcacgggaacgtacttcggtaggggttaaacccgatgagtcatcaatatacatattacgtttttccagcaagatccccatagtgctggaaatacgtgcccaatcttcatcgtcaagctgacccgtacgaatacgtgtttgatccacacgagaaagcgatgccagcatacgcatcataatctggttgccgggcatctcaagactgaaaataagtaccggtttatcctgcatcatcgccgcgttttcgcacaagttcatggcgaaagttgttttccccattgaaggacgcgcagcgacgataatcaggtcagatttctgtaacccggcagtttttttatcaagatcttgatatcccgtagagacccccgttactccatcatgtggacgctgatagagttgttcaatgcgttcgacggtttcttcaaggatctgttcaatgcctttcgggccttcatctttgtttgcccgattttctgcgatctggaatacccgtgattcagccagatctaataaatcttcactggttcgtccttgtggatcataacccgcatccgcaatttcatgggcaaccgcaatcatatctcggacaacagcgcgttcccgaacgatatcagcataagcgttaatgttcgctgcacttggggtattttttgataactctgccaaataggcgaacccgccaacgctatcaagttccccattctgctcaagcgattccgataaggtgatcaagtcgataggttgacccctttcgagcagacgctgcatttcagcaaaaatgcgccgatgtgggcggctgaaaaaatcattgctggaaactcgctcggaaacattgtcccagcgttcattatccagcatcaaaccgcccaacacggattgctctgcttccaaagagtgtggtggaagcttcagcccttccacttggcgatcttttggtccagccatactgttgttagttggtttttttccagccatgtataccgcattaatccactaaacaagaacgaaatagcgcatcagtatacgccatgaaaacaaccttgagtaattatagatagtctgcacttatagctaagacataatcacttgatattaaataaataaattttatttcttaactgaattttccttacttatttatataattgtttatacataaaacactgaacgaacctataaacaaagcataagataaaaacaatacaaaagaaaagaaagaatgagagtgaatgtgtgatcaataaaacatggtcagtacgctatccacatcgctaaaatcgataatttcttgggtggttttgggataggcataaataggaaatagtttgatgctgacttcttccattttcgatgtagcagtttcactgcgtgacttgccttcttccccgtgtaccacggctgcgccaccgaccgaaacaagctgtttatattcattgctgcgggtggttttcaccgtacaaatccggcgcatgaccgactcatcagccagttgctgcatgatctgcttattcagttcagggataacggtatagccgccctctgagggaacgcccgtagacaaggtgcgggtttctccggtcagaatatagtggcgcagttcgtcgaactgtttggcttcatcggcagtcaatgagtgcttttcgtcttcggctttggtgagcaacgaacgcatttgttcggtaaaggttgctttttgctggcgtaattcgagcagtgttttcataaaagggtttccgtaacaatgatgttaagacgtgaaaccagcgctgagaggggcaggccgaataatctttttctgcgtctcgcaggctacttctcgcagcttgattaaacggcctgatggcggctcacgcctgagtgccacctcttaatatatctatgaaaaatataataaaaagacctcagcataggaggtctaaacttgcggaaacatgaggacgggatatttacaaaagttttcacttacataacttaatgtctttaacataagtcgtaggtgacatccatgaaattttatcacatgtcagataaccatcactttttaacttatagttaacataaaaagagacaggtaagctgatgataaatgataaaattgccagccaaaccataaagttaataatcactttattaaatttaggttgcctattaaaaataaagaaaaaaatagagcataataacgcgtaaaataatagaggtgaagacatgacaccaataacaacagtgccagaaaatgttatttcatctttcattaatattaatgaaacagcatcgccaataacaaaaataaccgtaaatattactaacaataataatattagaacacctaataattgaaagtatttactattcatctaaaccttcctaatccattaaaaaaatgctgtaaatccgcttccggtgttcttggttttcttttcatttcttctttcaaaagtgctattaatttttcacttatcccatatttcttatcaagagtatctaaaatataagccgctagaactccaacagctaaaactatcagagcaacagcaataatacttccacctaaaaatgcagtggcagttaaaagtgatcctataacccaggaggaagcagcaataatagcggttttagccatatccattgttatgtttccgataaaatcggctaaagtatattcatccttgaaaatactttctatcaatctatagccaatcgaaaagacaatacagaatctaacacctttgatgatactagcattaagcccctgctgccctattcccattccaagcatttggggatttttggcacgatagcgtgtccccatgatacgactcctaagacctgcatgccctgatatgtgaatatacttttccccattttttcctacatgttctgtagctttaatgcccaagctcttaaactctctgcaaacttcagaaaacccatgcgtatcatagatatttcccgcataagtggaaataggatcagtgacagaaaatatatgtgccataggattttttatcttgttgccggagtccgtacctcttgaaaatgcttcttcataacttagatgtttttcgttcatacctcttgcaaatgcatatccataacttggactttgtggacggcgggagctgatatcctcaataatgctttgagcttctgataatgtgagaacaaagtgatattgggtattatctctcaatactttttctagcccaatagcatcaaaaaattcatgctggggttttagctgattaattcctacattaccccttaaaacatcccccatataaccatcccaagtggggttatatttcttatgtgtcattccttaattctccatagcactcaatatcaaattaataattgattgacttgtgtcaagattcccgatgtagcatcaattaagcaggatataacaacaatgcttacccattccagcatggaaaagatacacctttaaatttgtgatgaatctctattcttaagcaaaatcagacaattacttaattttaatttcagtcacaccataataaaaaaattatgcactacttggaggtgtcagagcgggagattaatcttgtggcaaaccgattaaataatcgtcctcgtaaaatacgagattacaaaacaccgaatgagttatttaaaggaataccctctcatttacttcgtccattacggtgttgcgcttactatgtgaatctaagcaagttatttattatttgtcgcgataatttcaccgagaaactcatgagatagaaattttttgtggtgttacttttttatttcttaataaacacaagcgaaattacgaaaattttcatgttaaatcacctttattttttactctctatataaatacatgggttttcgccgagttacggaattgatatgtttcttggattcacatattaagcgcaacaccgtaatggacgaagtaaatgagagggtattcctttaaataactcattcggtgttttgtaatctcgtgttttacgaggacgattatttaatcggtttgccacaaggttaatctcccgctctgacaccttattaaaatcagttccttttgggaagtaatctctgattaatccattcgtgttctcatttatccctctttcccagggggaatacgggtgagcaaaataaatttttgtctctaaatttttactgatcagttcgtgttcggcaaattcgaggccgttatcaaaggtcattgttttaattttatgttttatcagtgataaatgtcttgttgccgcttttgcgaccccttctgctgttttattttcaagtttaattataatagtaaataacgattttcgttcaactaatgtcaataatgcacttttatgatttttacccacgatagtatctccttcccaatcaccaatacgctgctttttatcaacaagtttggggcgcttatcaatactgactctgtttttaatttttcctctgcgctcataacttccatagcgtttacgatacggttttttcgcaatcctaagatgttgccataaattaccatcattaagtttatccttataaatcaatcgataaactgtttcatgatgcaaagatattatattttcccttttgagataaccgactgtttgttcaggacttaaatcttgccaaattaactgtttgatccacatttctatctctggtttcacttttactgcttttgtagcacactgtcggcgcgctacggccttaagctgagcttgttcaggcgtatatttctttgcctcccgatttcgtctcaattcccggctaatcgttgatgggtttcgattgagtgactttgaaatctcccgttgtgaaaaaccggcttctttcaggctgaaaatctgatatctttctgtttcggtcagttgtttataggccatagcgcattttcctttggcaagaaagatgcctactatagcaactgaccgcctttcttagaaattgcacttattatgcgaatccaagtatctatttaactttaatggcacaattgattaactaaatttttatagtatgtcttacgtaggatgttgctttgattgaatcagaacgccgggtttattgatttaacgtaacggaaaaaatatttcttttacggtattttcttacgtgttgttataagttctgtttatttatataaagagaggttatgtgtgaacgaatcattgctgggtttttctggatatattaaatttttgatgggatttttcgcgttggtgaaccctatcggaattttacctgtttttattagtatgacgaattatcagacaccagcgggatgtaataaaacaaaccttatcgcaaatttatctgttgccattattttgtgtatttcattactgataggtgattctatcctgcatatgtttggcatttctatcgattcatttcgtatcgcaggtggggtgttccattggcattgcctattatgacagggtcgggagctatcagtgcctgtattgtatggagtgcacgttatcaaggatggcaaaattatttaggacttgcattaacctgtctgttatttactttttgttgctggttattatttcattcagcgatcttactggtcaagttttttgggcaaacaggtattaatgtgattatccacattatggggctactgttaatgtcgctgggaattgaatttattgttacaggaacaaaagctgtgttttctggattactgggatattgcacaggtaatgataacgctggtactgatttggaaagttaatataaaaaaagaaactttttactgaaataggtaatgcattaaccaaaaatgagttgataaacaaccaattataagcattattaatcaatggtgtcgtttctgtatcatttttttaaaacaattagttatattttattcctttcttatcggctattgctgcaaagccatactgtaattttccacactattttctttccattattccactaacgggtgtcttgattctctattttgtgatgaatgtggacttttactctgtgatgattgcattttgttaaaataatgtttattttcttttttggtagaattgtgtggatccaagacgataaaaataaaaataaaatcaatgattatcaattgattatatttgtttcgtgaatgtattttgcacgaaaatggcaagttactttaactatttaataaaccatttataaaaatattataacaattattattcgaatgtggatttttaatagacgaactaccctttattaacaaaatgagtaagatgttgggattggtcaattaaaaaactattaatttactgttgataacttggagcggaaaatgaggaaaacaccatcaaagttgagtcagttaatatcgactattgctttattatcgtttcctgtagcgcagggaatggctgcaattgttcctacaggagtggcattggctgaaaagcaggaagtgaccgttaataatggcgttgaagtcgcttcacttgatcctcataaggtcgagggtgcacctgagacggcaattattcgcaatctactggaaggattggttacgacagggcctgatggtgagactgtacccggggtggcagaaaaatgggaaaatgaagattataaggtctggacgttttatttacgtgacaatgccaagtggagtgatggtaagccagtaacggcccatgattttgtctatagctggcgtcgccttgctgatcctaaagtggggtcaccttataccagttatctgcaatatacttatgtccagaatgctgaggatatcttaaaagggaaaaaatcgcctgatcaattgggcgtcaaagcgctggacaatcaccgttttcaagtgactctcagccatccggttccctatctggtagacatgttgagccacacagcaatgaaacctgtcaggcaagatgtggttgaggcattcgataaaaaatggacgttaccagaaaattatattggcaatggggcttatgtactgaaagattgggttgtcaacgaacgtatcgtcttaacacgcaacccacaatattggaataataaagaaaccatcattgaaaaaggcaccttcctgcctatcgtctcagaagtcagtgatattaaccgttaccgcagtggtgaaatagacattaccaatggtgctattaccccctatctgtaccaaaagatgaagagggatattccagaccaactacacgtttcacctttcctgtgcacgttttactatgaaattaataacaaaaatccactgtttaaagataaacgggtgcgtgaagcgattaaattgagccttaatagaaatattatcgctgaaaagattatggggcaggggcagattccggcttatggcttcactcctacttacattggtgatcgtggctttactaccaacccagaatgggcaaactggacgcaggaacaacgtaaccaacgggcaaaggatctattgaaagaagccggttttgatgtccgtaatcctctcaaattcactttgttgtacaacacctcagatcaaaacaaacaacaagctattgctgcagcatcaatgtggcagaagaacattggtgcacaagtgatgttgcagaatcaagaatggaaaacctcactggagagccgccatcaaggaaattatgatgtggcaagggcaacatggtgcggtgattataacgaaccttcttccttcctgaatactttgttgtccgatagcagtaacaatacaggcttctatcaaagcgctgcctttgataactatcttggtcaggctctggccgcgaaagatgaagcagcacgtaaggtattctaccagcaggccgaagctcagcttgataaagactcagggctgatacccgtttattaccgtgtcagtgtgcgtctgattcgcccgacggtggtgggactgacagggaaagatccccttgattatatcgatcttaagaatctctatattagaaaagcgaataattgatcgttattgcaaaggattgtcttactgcaaacaaaatcgtttcttttggatacggaaaacaaccattccaaaaaatgaatatggcttttaaaagtcggatgatatcaattggagtaataataagatgatgaacacaacaaagaaaaggttagctgctggcattacggtagcgttaggtatgatgacgggttggcaggcatttgccgcacaagttcctgcgggggtgcagttggctgaaaaacaagtcttggtgcgtaataatggctctgagccgcaatctttagatcctcataaaattgaaggggtaccagaatccaatattgctcgtgatttatttgaaggaattgtgattaatggcccgaatggcgaaattttacccggcgtagcgactcattgggaaaatcaggatttcaaggtttggacatttcatctgcgtaaagatgcgaagtggtcgaatggtgacccggttactgcgcaggattttgtttacagttggcgccgactggctgatccaaatacagcatcgccttacgcaagttatctccaatatgctcatattcttaatgttgatgatgtcatcaagggaaaacaaaagccggagtcactgggtgttaaggcgttggatgaccatacctttcaggtaacactcagcgaacccgttccctatctggtcagactattgattcattcgacaatgtcaccagtgcaccgtgcaacagttgaaaaatatggagacagatggactcagccgaaaaatttcgtaggtaatggtgcttataaactgaaaagctggaacatcaatgaacgccttgttttcgagcgtagcccgacatattgggataacaaaaatactatcattgaccaagttaccttcctgcctatttcgtctgaagtgactgatgtcaaccgttatcgcagcggtgaaattgacataacttatagcaatctaccgatcgagctattccaaaaactaaaaaaagaaattcccgatcaactacgtgttaatccttatttgtgtacttacttttatgaaattaacaaccagaagccacccttcaatgatcctcgcgtccgtaccgcattaaaattgggtatggatcgcgatttgattactaataaggttaagaatcaaggtgacacgccggcttacggttgggtgccgccttacattgccaattttaaagatgaaaaaccagattggtacactaaattaaaccagcagcaacgtaatgaagaagccaaaaaactcttggcagaggcgggatttagcaaagaaaacccgctgaaaatcagtttgttgtataacacttctgatctgcataaaaaaatggcgattgcggccgctgccatctggaagaaaaatatcggtgctgaggtttctttagagaatcaggaatggaaaactttccttgatacccgccatcaaggcaattatgacatcgctcgtgcaggctggtgtgctgattataacgaacccactactttcctgaatgttaaattatcttatagcagcaacaatacagctcattacaagagtgaagcatttgatgctttgatgaaagaagcactaaaagtgaagagcgatgcagaacgagcagaaatctacaaacaagcgaatgctctgatagataaagattccgccgttgttccgctttattattatgtaagtacccgtttagtgaaaccttatgtggggggttataccggtaaagacccattggataacatccataccaaggatttttacattataaaacactaggaacagtcgggtggcctgaatcaggtcacccggctgtaaaattattaaaggccatggtttggtcaaacaataggaacgggcaatgtttaaatttattttacgccgctgtttagaggcgatcccgacacttttaattctaattactatttcatttttcatgatgcggttggcaccaggcagtccatttacgggtgaacgaaaattaccgccagaagtgatggcaaatatcgaagcgaaatatcatctgaatgatcctatctataaacaatacttcaattacttagtccagctttcaaaaggggattttggcccatcattcaaatataaagattacagtgttaacgatttggtggccgaagcattgccggtttctgccaaactgggatttgctgcttttattatggctgttgtattgggcgtcagtgcaggcactatcgcagcactgaatcagaatactaaatgggattacacggtgatgggttttgccatgaccggagtggtgatccccagcttcgtggtcgctcccttattggtgctgatttttgccattatattgaaatggctgccggggggaggctggaatggtggtgcaccgaagtacatgatcctgccgatggtggctttgtctcttgcctatattgccagcatttcccgtatcacccgtggttccatgatagaaatactgcattcaaattttattcgtacggcacgagccaaggggctgccattgcgagcgattatcttccgccatgcactgaaacccgccttattgccggtcatttcttatatggggcctgcatttgtgggcatcattacgggttcaatggtcatcgaaactatctttggcttaccgggactgggtcagttgttcgtgaatggcgccttaaaccgtgattactcactggtattgagcctgacgattctggtagggggattgacgattctgttcaatgccattgttgacgtgctgtatgccgtcattgatccgaaaattcgttactgagactggagcacgcaatgttactaaataaacgaaatagcgaagctctggaaaatttttctgagcaactggaagttgaaggccgcagtttgtggcaggatgcacgacgccgtttcattcacaacaaagcagcgattacgagtttgtgtgtgctgcttcttatcacactatttgtgatttttgcgccagtgttgtctcaatttacctacgacgatacggattggaatatgatgacgatgccacctgattccgaatctagccactattttggcaccgactcatcagggcgtgatttgctggttcgtgtcgctatcggcgggcgtatttcattgatggtcggtattgccgctgcttttattgctgtgatattcggcacactgtatggagcgatgtcaggttatcttggcggtaaagccgatatgatcatgatgcgcttgctggaaatattaaactccttcccattcatgttctttgtgatcctgctggtgactttcttcgggcaaaacatcctgttgattttcgtggcaataggcatggtgtcatggttagacatggcgcgtatcgtccgtggtcaaacattaagcctcaagcgtaaggaatttattgaagccgcactagttggcggtgtatctacccgtcatatcgttttgcgccatatcgtaccgaatgtattgggagttgtggtggtttatgcctcattgctggtgccaagtatgatcctgtttgaatccttcctgagcttccttgggttgggaacgcaggagccgctcagtagctggggggccttattaagtgatggtgccaattcaatggaagtcgccccgtggttgttgttgtttccggctggttttctggtactgaccctgttttgtttcaactttattggtgacggcctgcgagatgccctcgacccgaaagaccgttaaggagagcctatgaatagcgtagaagctgcaaaaaatgctaaaagtgctgtgccactattaacggtgaaagatctgaatgtcgcgttcagcacacccgatggcagtgtgatagccgtaaataaactgaactttgatttaaacgcgggagaaacgctgggcatagtgggagaatccggctccggtaaatcacagactgcttttgccctgatgggattattagccagtaatggtgttgtgagtggttctgctgcttttaatggaagagaaatactcaacctgaaagaaaaagatctgaaccgaatgcgggcggaagagatctcaatgatatttcaagatccaatgacttcccttaatccttatatgcgagtgggtgaacagctaactgaagtcttgatgttgcataagcgtatcagtaaaagtgaagctgtcgaagaatccattcgtatgctggatgctgtcaaaatgccagaagcgcgtaagcggatgaaaatgtacccgcatgaattctccggtggtatgcgtcaacgtgtcatgattgcaatggcattattatgccagcccaagctgttgattgcggatgaaccgacaacagcactggatgtcactgttcaggctcagatcatgacactgctcaacgagctgaaaaatgaatttaatacggccattatcctgattacccatgacctgggtgtcgttgcaggtatctgtgacaaagtactggttatgtatgcgggcagaaccatggaatatggttctgcgcgtgatatattttatcacccgacccatccatactcgattgggttacttgatgcggttcctcgactggatgacgatgaggaatcattgacgactattcagggcaacccacctaacttactgagactgccaaaagggtgcccattccagccgcgttgtcaatttgccactgagcgttgtgccaacgaagagccacagttggaacattttgatcttgggcgcttgcgtgcctgctttaaacctcagggggaattggtatgaacgcagcagctgaaaaacgagtcctgttggaagtcgatgacctaaaagtttattttgacattaaagacggaaaacaatggttctggcaaccagcaaaaactctgaaggcagtcgatggcgttacactgagattgtacgaaggagaaacgctgggcgtagtgggtgaatcaggctgcggtaaatcgacgtttgccagagcggttatcgggctggttaaagcctctggcggtacggtaacgtggcttggacaaaacctgctggatatgagtgacaatcagtggcggaatattcgtaacgatattcagatgatttttcaagaccctctggcttcccttaatccgcgtatgacgattggtgacattattgccgaaccgctcagaacctatcaccccaaaatgaaatctggggaaataaaagaaaaagtcaaaaatatgatgatgcgggtagggttgttgcctaacctgattaaccgctatccccatgagttctcaggggggcaatgccagcgtattgggattgcccgtgcgctgattctagagcctaaactggttatctgtgatgagccggtttctgcgctggatgtttccattcaggcacaggttatcaatctattgcaggaattacagcgggaaatggggctttccctgatatttattgctcacgatctgtcaatagtgaaacatatttcagaccgcgtattagtgatgtatttggggaatgcagtggagttgggtacttatgatgaggtttatcataatccgttacatccttatacccgcgccttaatgtcagctgttcccattcctgatccagacaaagagcgaaacaaacgcatcgaattgctggagggagagctgccttcgccgattgatccaccatccggttgtgtatttcgaacccgttgcccaatggctgatgcagaatgtgccaaaacacgtccattgcttgaaggcagcttcaaacatgccgtgtcttgtcttaaggttgatccgctatagttttaagtgtctgtttagtgtgacactgtcactaatctatattctaagccctcgttgtggagggcttatttataggcaaggacagttgaggtgaattatttcttccataagatctggctgattgggtgagatttttcccgacagattaacactcgtgcaaagatatcatcaatttcagcatcgtcagatgctgctaagccaataataacttctgcaaaaaaatcaggatgtaaatcaaaatcaacatgttcaagccatatcgctgagggagctaataattcagcgccacctcgttcttcaaactgtaaattaaacaatagactatctgccggatcgagattggcgatcgcttgttccagaaagatatcgtaggctttttcaagcgtttcatcctcagtcatccgattattgaaatctaattggagagaatgtgttggtttattttccatgatggtattgtccgaaattaataacagagagaaattaaaacatgatctgtagtgattgaatacccttactgctaatcacagccccaatgatactaatggggctgtggaaaatattgactgatgataatggaaataatcttttaggcaaaatgttacaaaagtgggctgaaaaaataacagatacgttcaagaatacggtgccagagtgggcgtttcgcccattcctcattatcaagcaaagtcgagcgtgcaatatagccctgctggacgaatgttaaatcattgccgaagtgcttatcatcaatcacaaccgtgatttcaaaatttagccacaggctacgcatatccagattaacagagcctaccatgctgagttgtccatccactaaaacacttttagtatgtaacagaccatcttcaaactgataaatttttacgccagcttctagcaattccgtaaaaaatgcccggcttgcccagcgaacgagaaatgaattgttctggcttggaagaataatactgacatcaacgccgcgcatggcagcggtacaaattgcgtgcattaaatcatcactgggtacaaagtaaggtgtggtaagaataagctgctctctggctgaaaaaatagctgtcattaaggactgctggatcaactcatcaggaaaccctggcccagaagcgataacctgagctgtatgtccactggcttgctcgaaaggcataatagggctgtcaggcggtgacggaaggtggcgctgacctgtttccatttcccagtcgaaagcatagataatccccagagtcgttgtgaccgggccttccattcttaccatgatatcgacccattggccgaatcctgcatcttgtttgaaaaagcgcgggtcaaccatattcatgctgccagtatatgaaatatgattatcgataagaataatttttctatgttgacgtaaatccatgcgacgcaagaacagacggaaaatattaacctttagtgattcgacaaattcaatacctgctttgcgcatgatgtcaggatatggactacggaaaaattgccagcttcctgcggaatccaccatgatacgacatttgacaccgcgtttagcagcacacatcaaggcatcagtaacttgatcaactaacccgcctgcctgccatatatagaataccatttcgatattatggttggctttttcaatatcattaacgatggatttcagagaattatcataagaagtcatcagttgcattttattgcccctgacccctttgatcctctggcgccgttcgcataattggaatagcggttcagctacttcactattttcatgggcaaaaatatggggggatttttttaactcagagagccatttagtgacagatgaacgcatttgtttggcttgttcgactctgcgtttgcctagatacaattcgccaaatgacagataagcgacaattccaaccaaaggaaggatataaatgataagtacccaagtcattgctgatgttacaggccgacgtttcattaaaacacgaattgtgataccggcaataatcaaccagtataagaaaatagccagccagttcagtactgaataaaaggttgtcatacgtggcaatcaatcctgtttatttaagtatttcatactgtttttgtcgccattttatggaaatcctaacaaaccatcagctaaatgtagtcaacttagcagagaataatcaaaacattaccaatatcatacctgatgtcgtctcacaggtattatgtaatttgattcagttaaatcatgaatcaattatatatctattaactaatgacttagattcaataccgcattgtgttaaaccttacattggttgacattactagcagtggggattaagaatacggcacttagctgaatgagaggattaaatcgggacattttatgaaacatagcagaaatgaagtcggtcgatggcgaatgcttcgccaaaacatccgccgtcgtcgtcgctggttagaggggcaatcacgtcgtaatttacacatctattcgttgcgtaagactgatggtgacaggcgtcgcaggtcgattctgttcgtgcagagcagggaatttctctaactataatgtgtggcatgatacagatgtttttgaatcatgattgaatatgatagtcatttgcatttaaactagtactatccgaaaactgactatcatgctgctaatcaagaattctcttatgcgttggatacactggccggtattactttctgtttgtttacatgtttctattgctgcggcgctctttcatgctattgaacccgaaaaacagctagaagcgactcccatatctgttgctatgatccaactggcagcggaagaagcccctgtctcggagcctgccatgcctgaatcaattcctgaaccacccgaaccagagcctgaacccgaacctattgcgaagattgctctgcctaaacctgagaaaaaaccggaagagaaaaaggttgttaaaaaggagcctaagccgatggagagaaaaatggagaaaacatcggaacaacctgtcaaaccagtttctgatgactctcaaatggcgaataaccggaataatcagttaaaaccaacccatccagctcttaatgacaaacctaaagtgcagaatgggccaaaagcattaagcagatcagtgcctgtttatccatcccgagcgtggcaattgggtacagagggaatggttaaggtaaaatatgatattgacgaagatggtagggttaaaaatattgaaattattgctgccgatcctaaaaacgtctttgagcgggaagtgaagcaggcgatgagaaaatggcgttatgaaaaagcgcctgcaacggggtatgtgacaaccattgaatttaagcttactggtatttcacagtcttaatcaatatcttcatcaaaaacagggggacgcaaagcgtcccctgactgctcatatagaaatcatattttatagcaagtagattttaattatttcttaatacttatctgaggggagttgaaataagtaagaatgtattattatctgaattatttattttataaataaaaaggagcgtaatgaatacgcccctttaatttatgggatcacgttcctaatgcatcattacttcgaatcactgctttccagtttgaactgagtttttccttcgggtaaacggcgggaagtattatcttcattaacagcgacatacgtgaaaaccgcatctgttgcacgataacgctgcccaaccggatcggatgctacttttttcacccaaacttcaatatgaattgtgatagatgagtttcccgtttttagacaacgggcataacagcagacgacgtcacctaccgcaactggttttagaaaactgataccatctacgctaacagttactacgcgcccctctgcaatctcttttgccagaattgcgccgccaatatccatttgagacatcagccagccaccgaaaatatccccattggcattggtatcagcgggcatggccagtgtacggaggaccaattctccgtttggtaagcattgttgttgtgtcattagaaaacttgctttatttggtgaatacaacaatacctgccgatgtttcggcaggtatccatatgaaggtcattatttttgttcgcgaggcagatgacggtagatatataccacactcaacacagtaaaaaccagcgtcaatgcggttaaaccgaacactttaaagtttacccaaacatcttgaggtagccagaaagcgacataaatatttgccagtgcacaggcaataaagaaaatagcccaagctatgttcaattttttccagataaagcccggcaattccagttccttacccagcatcctctgaatcaatgtttttttcatgaaccattggctgataagcagtgctaaggcaaaaatagtataaattaccgtcactttccatttaatgaataaatcactgtgaaaagctagtgtcagtgtgccgaaaatagcaaccacaataaaggtgatcaaagatgatttctcaactttgcggtaaatcagataggtgatgacaacagccaatcccgttgctgcgatcaatgcccctgacgcataaaaaatgtcatacattttgtaggcgatgaaaaaaacgactaatggcaaaaaatctaaaagttgtttcataaattgaatccactgtagtgccgatggtggcatgttcttgaatttgtgccagagtgtatcagatctcaatgaaatggtttatttatcaggtgaaaaaacatgtttaaccctatttagctaattctaccataacgaacaaagaagctgagaggtcacggataggattgtgagtttttattgaacatcgcattataatgcgctccattcacgaaaggactaaataccatgttgtggaaaagattatatcgctggatgccggggttggagaatttttgttattaccgtaaagagtattttagtcatgatatacggtcaggtctttcggttgctgcggttgcgttacccgtggcaattgcttatgcggagttaatgggaataagcgccatcattggtctatatgcctgtatcttaccgatgtttgcttattctttatttggcacttcccgtcagttgattgtcgggcctgatgccgcaacatgcgctgtgattgccgccgctgttgcaccattggccttgggtaatgaacatgttcgctggcagcttgctattatcatgacactgatgaccggattctggtgtattttagcgagccattttcgattgggtgcatttgccgattttctgtcacgtcctattttaaaaggttttatcaatggagtggcgattaccatcatggctgatcagcttgctaaagtcttcggactttcgggtttacctccggaattaattgagcggttaattgcgcttccgcataaattattagaatctcactggccaacagtaggtatttcagtgatgactttactggtattgttaagtgtgcgttttctgcattcaggttggccagctccactgatagcgatgatcgtttcaacctatgtgagctggcaatttgaactgaatcaatatggtatccagatcgttggcaatatggagagcggtctgcccatcgtcccaatgcctgaatttcaacttggtgttatgcgtgatttggttgttccctccattaaccttgcggttatcagctttgtcagctttatgatgacggctcgtagctttgccagtaaaaatggttatcaggttgatgcggatttggaactgcgggcattgggcattgctaatattgcctcatcattatcactggggtttgctgtcagtgctgccagtagccgtactgcggttaatgataccattggtggtaaaacacaaatggtgtcggtcattgctgctactaccatattattggtactgctgtttatgaccgaatttctggggtatatccctttatcatcactgggtattgttctgatcttttctacatggtccttgttggggttaaaaaatatctggtcatatcgaaaacgtaaccgccgggcttttacgctatctattttcacattggtagccgttttgctggttggtgtgattgatggtattggctttgcggtattacttggtctattacaatttctgcgcatcattttccgtccctccgatcaactattgggtgtcaatgagcaggggatgatccactccatcaatcaaggtaatgatatagcatcggtggatggcatcatgatgtaccgctttaattcgcctttaacttacttcaatgttgggtatttcaaaaaacgggtattacagcatgtagagagagcatcgagacatcctacatggctggtggtagatgcagcggttagttttactcatgatgacgtaagcgtttttgctgtgttggatgagctgattacggaattgaaagaaaaaaatgtgactttagtactggcgggacgcagaacagaattaaattactggatcaagcagaacaggcttagtcgtagtgatgaagatttgattgtcgtacctgatctctattttgccattcgtttgattcaaagtaagcagcaagtagaagaaaaaaaagaagaatatgcttagaatacctcgccctttagaggttgtcgcaaaaggtcaccattatcagctaagctctgtgttcctgttttaaacacagagcttttatggcgctattcacacgaaaactgacaccttccgttcacacaggatgtcagtttgttacggctcaacacctacctgtactgagtggttctctttcataaatcaattaaaataaacactgaaaataatattttaagtaatttttatattttttagaattaatatagtaatttttcatttgtttatttggctatatgtaatttatattatgtaatgaattatgaaataataatattataaagtggaatttttcctgatatttcattgcatgtttatcctttctatttatttatatttattttgcattatattgtgatttatattaatagttggtatgaatgaagggttatttaattcattagccaaatgataattttttcatataattcaatttattgcaattaccctttaactaggtgtatcaaaatataaagtttttacactcaagattaggtatatagatttactaataaattagcttatttttcgttttaaaatccatcgaaaaataccgaaaatattgctattgatataagtaatgtcagagctcccgggtttctgacctgaatatcagtatatgttccatgctgatgactaaagcctgtaataccggatcagaacccttcattcgcaatgccgctatccgaaaatgacgaagatacaaaatgttccgaataacataccgttatatcggaactgcaaaggtcgttataaagcctttgacgtcatatccagataataaaataaatgaaaacaaatagataacaaacatcatcgttataaatcaactaattgatttatagctgtaattatttgcttaaatcgcaattgatattggttatcattttgataataattatcaacatagttatatatctttagatattctgactaattttcgcgatgcaaagagcttcgctcaaaaacaggcaaaggattactgtaatggtttatatgtccaaagacttcaaaaaattgctcaatactctgatcgatcgacagatagaggtggcgggtcgtcagaccgaatggttcaacatgagtgccgacgcgcgtgccgactatatcaggcaggtaaacgaacggctgcaagaaatgcagcagagtaccctgagtgtgctggctgctcagcattttcagatgcaggacaaccctgtttctgtcggtgaccagttgcagacgctacagcaaaaacggcagcagatggacggtaaatctgacacgccggcgatcaaggcctacaagcagcaactggatcgcgacatccggttatacagccgccagcaggcggccataacgcactttaacagctctaggaaaaaggccttggatatgctcaatcccagcggttccaagaccttgaatgcgatgactctgagggaggatgcggcggtcaagcaggctaatctggataccgagatcaagcatctggaacagcaactgactatacaggtgactgactccacgttcagcccaaaatacgtgaggctgttttccaggctacaggcctacaaggatgtcaaaacccgctacactgccttgctcgagacaccctctaaggatgaaacaaaagaagctaaggctttcagcaagctgatcgaaatgcctctggcctctgatgatttgccggtaaatatttcactgttaatgatggaggaacgtcctggctacatccgcatgaacgttgctttggttaatgccagccccgatggccgcttcaaggacttcttcctgaaggatggcaggctggtcgtgcctaaggacggggtatttaacttttcctttggtactccagcccgctctctggcctggcaacaacaataccggctcaaaagtgagccgccatcctttcgctctccgacctatacaccaattcgctcggtactggtcaaaatcgaattcgtcgagaagtacttcgctaattacctggtttcggaaagcactgagcgcgaaggcttcaaggagcattttctggataacgatcgcaagatactgttgatcagcgttgaccgcaaggtaccgaaccaaattgggattaaggtgtccggccacacccatgaggttccattggctggcaccttgagtgacctgatcaaccagaatgctgatatcaccagcttccagactatcggcttggaggattttcgccagaacagttatgacccggatcgtgatgggcttttcatcaatatccatgagctggaacgcacggtcggttttggcaatcgccagtacttgctggaaatgccacagggcaaaaccccgagcaaaaactacctgtccgcaacaccctttggggtaatgaacgttgacggcgacaaagtcagcagtagtcacttgagtaaggcacagaccgctgaattgtatcaatacaacgccgcatttttcgagaagctggatcgattgcgagacgatggtgcgaaggccagtcgtttgtttgaaggcagcagcgaacgcaaagtgttcgagcagcaactggtgcgtttgctcgaacgcaaccacatcacccccgcaggggtgttggagtcggaatacaccaatgacagagtgcgcgatatcaagggcaataacctgaacaaggtgttgtgggaacaggcgtttgccacgtcggtctgggaaaacaccaataatgacccgctattgttcaagctggcgaatagactgaataatttagtgttctcctccacagcagtggacaagatcctaaaaaatagctatgtgcaaagtgacatcgcccaagtcaagggattgctggcacagcagtacgaacaatggcgcattcgggccaccgaagaagaaacccagcggatcaaccgggctaatgcagaacagcatccaaacaacccgaaagtacaggttttcaatcagaccgaagttgaaagctcgctggacagaaagctactcgctttgttgttggtcggttccgagaactttggaagagccgatgagcaactgtatccggccgttaaggcagctttattgagcaatgagggcaggagtctgtgcaaacaggtcttgttccatgtcttgcgaccgatagccgatagcttttccaagccagcagtcccggtaaatcctcatgctgaactgatgtcggaaagaggggataacaaggtcataatcaataatcgactgaatcagccagacccgtatctgatcctcaatacccgccctgaggagcaggtatatcacgatggttcgtacctgattaaggacgacaaataccgcagctacaaccaattccgtccggatcccaagaataaggctacactctacatgaatgatctggataccccgttcgtaggcgggatttcagggaccacccagactgtcagcaatgtcttaccggaattgttcggtgacacattgagcgtcaaggagtactggaacttccagatggtcaatgcggctttcatgatccgtaacggatatcactcgttctttgaaaccttctacgtcgctgcacgttacgaaccggagggggcggacagtatcggcaaagatatgttacagatgttcgacgaataccgcgctgagggcagagagaaggcattgaagggtgaactgtatgacggagtgatggcacgaatcttgccgatcatcaatcagggcttgccagaggctaagaagttctattcaccgcgttttatgccgacattgctggatcaggaggaaggtcgctatcgtcatgagccagagggtattgctccgttcgatgaaaaacctgtcagtaactgggaaaagcctgtagttgaggctcaccatgagggtgaagtatcccgctttgatggtcagctgattattcagcttgaaaacgaccctgtagtcagggaagcggcagcaaaattagtgggaaaacaccttaattcggtgctggtgcagctggatgcccggggtcaatatcaggtggttcatggtgatctgactatcctgaaagataaagaaaaaatccgctggcaactggttggtcatagccgcgatagtggggataaacctaatcaccagacgctggccaaacgcactccggaagctctggcgtcacaactccgccagttctatacagactccggcgttcaaacgtcccctgaacatatcagtatggtaagttgttcactggctggtgaaaaccagcaggaaagctatgcgctaaagtttgctcgggcgcttgaccagcgtattcgtccactttctgttaaggcttataccacccaaattacggtcagccctgaaggccggaaacaactcatggaaaacggtaataaagccactcttgtttttaatccggaggatagtctatgggcgataaccgtaacgccaggtaaatcagttcctgcagagggtatggttaacccgccactgggaaacaaaacggctccggttccagacaatgtgcagattgacatccggctgctggagatgcttaaccgtgcagaagattttcagcaggccacggaacagctgtacagcaaaaacgcactgcccgcagaagaatggctaccagtactgggcagcctcagggagggtgaatcccggtattctttacagtttattaatatggcacggtctgagcttcctccccagacatttacgacggatgaccgacgtattattgattttattcattcttatgataaagatctcgaaactgtcagcaaaactcacgaatataccaaagggaaattaaccctgcgcacaggcatccccgaagcagaagctgttcacggactaaattccgcctttatggttaagactctgatcccttggtttgccgatagaaaacgcaccaccgtagccagtgaaaaggtgcccaatacgttagagaccgcactgcgggtgcacacttatgttaatctggcacagatggctcacggtatgctggaggacggcgctaaactcgccagtttgtacagggtggtggctagtgaaggccggggagtgaccagcagcctgttttcatcgctgtcccatgtcagcactggtgtcggggcggggttaaatatcttcagtgtggcactggacggcatagaactggcgcatgcacagaatgaatcccagaaggctgtttatggtacccagctggcgtttgacagtgctggtctggttacaactggcgtgggcatcggtgccgggatcttcggtgctcctattgttgctggttttgcctcctcgctggcggtaccactggctggtttgggtattggttttacggctctggccgaggcgttcggcagggtagccagtgatgcacaggcggtaggcaattattttgccgatctggaagcagcttatcagcagggtggatatcggcagacggaaaaagtggcagcagatggcagccgttatacggtgatggaaccgattcccggtgccgtgacccgtcagctcgatttgcgccacggtcatctgacttttgacagccagtatctttatcgcaacgacccgacttattcatggggttcgggtaagagtaattactttttctggtggcccggtagggcggctgatacggataaaaagcatgcaattaatatccgcgaaggcatcggtcacaaacaggcgcagatcaacttccatttccgtcctagaagcagcgacatattgatcctgccagttaccatgaagtcctatattaattatgaatatatgatcctgcccttcgtcactgcccgcaacgatcggggatttgacgttctgcgccgactggaagaagatggacgattcgactttgatttttatgcttttcccggagagcgcgtggtacgccgcataaagccggaatttgttgcgacgccgattgatatcattctggacgatgaagaccgggatattgtcattcagcagttgccggagaaggatcacgggatcctgtcctatcaattgaccggcgggaagggcaaataccgtatcagcttgcaggagggggtttctctgtccttacagggagacaccggtacccactggatactggatgcccgtcatatcggctctaatgttaacaccagtctcagcaaaaaagataacagacaactactgcatatcggcagtataaagataaccctgcctgaaaagacggataatatttctctgataaataatgcagggatattttctgtcaagcagaacaaagagaatcagtggcagataacagagagcgtaacgaatgctatgcagtttaacagcctgcaggcgttgcatgatcatctcaggcagttaagcaattctgaacatcacaacaggccatatttggtggtggaacactaccagtactcaccgcaaagccgtcctgtcggccgtgcattctatgagaccggtcgtgatcgtatgatttacaccaacgtccctgacgcagcagattttctcagctatgcagagctggcgaaagttgaaggtaataaggcgtggtgttaccgggataccacgctctggcaagtggatattgtcagtggcgaggttctgcggcagtatctgccgataaaatttccggggagtgatcaggggaaaatcagcagccatgtgatgcagagcaatgaccagctctggtttgtggtggaacagcagctggatgagggctgtatctcatatacttatcaggtggcagaggaagcactgaaactggtggcagttgacgggaatacggtcatgctggcgggcctggataaaatcagtgaaaaaaactttgtcgcgctgcctgtcccacttgattccagtgacggtgagtttaatggccttctggcaccactggcggcgaatcagtggttcaccggcgatctctgtgcgccggaacatcaggttaaaggcagcccggcggaggtgatcagcctttctgggcgagtagcgggtgtagatagacattactggttacagacggatggaaaacagctgcagaatgtggtcagaatgaaccggataaatccggatcaggaggatgcaggcatcctgactgagctgaaaaagaaaaattcggatttgctgaccctgacggctgatttcacccgcgttttcaccacgaccggtgataaaccgggttattatttttacagccatcagcgacatagtctttattttcagcaggataatggcctgtccggcactccggccagcaaagtggctgttgatgatatcagatccgtatccatagcgaacaagcagttggttgcactttccagcagggggatgctgtggctggcagatgatcagggcagtatccgtctgatcggggtgacggcagattggttgcaacaacctcaccagaagggtctgacagctgccctgaatcagttggcgcaggataatccagatcggttcagcaccctgctgttgctgggattgcaggatagcaacggaaaaccaatcagtgcttggtatgacagtacagcaggtcgggtggtgcagggcggagttggtctcattacagaacacactctgacctatcttggtttagcggaagatggcagtcaggcatggatttttgacactgataaccatcagttataccgtcagccactgtcggtggaggctgaccttaagttgggtgaaaagcaggtgctctctgagaaacctgttgcagcggagccttggcttcgggccagccatcaataccgcagtgcggttcgtcagggcaatacactccggctggaaaccccggacggcgcggtcttactgctgtcagttgatgccaagatgacagaccgcccggtgctgattgcctggcatgtgcaggatcgtgctgacagtcaaattgcctcagccattgctgcgctcaggaatgaggctgaattaccgcaagcagttagactgttttctgagcgtagttatcctgcttggtacctgccagaggaagggaaaatgcttcgttccggcatagttaattcggatcatgttctgcattacttgggtcaggtcgccgggcaggaggccagttatgtccatgaccggactaccggagaattgtggcaagtcagcgaagaacagtccacactagagggaaattactgttttgttaaccgaacaccggagagtctggtgttgcaggtggggcaggttcctctgggggaaaaaatccgtcttccgcaactggcgggcactgatcggctggccatcaccgggcgttcaaaagaattgtattactggctttcctcccccgaggcgctgacccactaccggcatatcacgatagatgatcggggtcagggttcagcgatccggttttctgatacctgcatagccaacctgtcactctggcgcagtgaccaaaatttagtgctgcttcatcaggcatcagaagacaccagtttattccttgtcaatattgaacaggcagcacagcgctatatgaggtttgaaagcaccggaacttcgccactgaagaagatgaagataattcacttactgagaaaaatggacaaactgacggtattaaaccccgatgtcagctgtttcgagctggtatcagaagaaggtgaactcagggtaaaaccggctgagtgtacagagaagttagagtcgttttcatctattccggagtattcagtacttatacccctgtagcactctacttcagttgcgataaaactggagttggtgaaaaaggctctatggcgtggtgttaagcaactggtcgatctaattggctagttgcacaaattttctgtattacgtggtgccctgatatgatgggtgatttattgcctgttattagtgtaaataacaggcaataaaaaatctgatgggaggttactttcccccatcagaaaggaacattgagcttttgtgacagactcgatagtgcgaggtgatttgttttattgcatgccatttgcagatttattttgcgatttagtcagcatatataagcggaataggtaaatcagtagtatggaagatagtaggttatttagtattgatagtacgatatcgggcattctagcgaaaccaagagcgataattagctttattgcaaaccatagcagtatggccggggctaacaggcgcagattggcaaacgctaatttccagctttcctgcatggatgagaaaacaccttttcctttttcaagcagaaaaacaggggcaaatgcaaatgcaatagagagcagtatgccgggtatgaacatcaacgcgtaacctaattgaatcaataaggtacagataaacatcagcaaaaacattttaggcagcgagcctattgatgatttgctggcgtggagcgcattggtttggtgtccgttagaaatggcattaataagtaacaacacattggcggtcagcaatgtactgccgaatatgttggaaaatagaataccgaatgctgtgcgtaagaacatgaattgttcttctggcgttaattgcgccacaaaatttttaactcctgtattacctgactctttaaaggcgttttgtatctcaaccagtagtttgagctgttcaccatcaggcatcagaagatgttcaagcagtactgccaccaacgcggctaagatagagagtatgaaaatattcaacagctgattcttaaaaaaattgaagctgtcacgatacaggatatttgccgtgatgggcatgaaagtggctcctatcagataaaacaacaatgatactcaattgtaccttgttcgggggattattggatacctaaaagataaagcaggtaatggttgaggagcattaacagatagaagaaatcaggggctaatggattatttttaaccaaatgatggttctattaattctgtgttaacttcagcttcgtttaaaaatagcgatatcacaatcccgtaaattcaagctcggttttttaggttggaatgtataagcaattaagccagcgacaatttccaataaaaaaccgaactgactacggtgtttgaatgttctatctgagaaatgtttttgagctgatccccggccgtttctatcaaaaatcgctttctcaacatcagtttattccagagagataacgcttttgccttcatgttattccggacatgagtgattaacgttattccttctgtttccagttcctgtgtcttagcatctgtacgtagccggccaatggcgataatatgaagcccgctgttcgctgttcgctgttcgctgcacgatcaccgccccggttgagccgatgaagtagatagcggtaatcgctattcagataatatattatcaatcatattttgtactacgatgaagttttcccctccaaaaaggttacagcgattcagtaagtagtaaagttgataaagaggttgtcgctcaataaaaccttgtggtaatggccaaatactttggtaaccatcaaaaatttgtaggggtagttctggataaaggggcagcatagcaaggtcacattcacgatctccccaatagcaggcgggatcaaatgctacggcagaattgctatttaatgatgcacaatttgttggccataaatcgccgtgtaggagagaaggctgaggttggtgagattgtagcttgtcactgattatttgaacaataagctcgatgttgccaaacaccattcccctatctgctgcaagttgtaattgccagccaatccgcttttctgcgtaaaattgattccagcgcttttgccatccattaggctgtatggtggtcgcgagcatgttatcaaaatcaaaaccaaatttaggttgctcactccattggtgcaatttcgcgagttgttgaccaaagtagtatgcactataggcagtaaatggctttataggtaaatactccagcaaaagaaaactatggtctcgatcgtatccaacgccgtaaacatgagggacatggatagttttgctgcgggccagtaattccagttgctctgcttctgttttaaaaacaggtaacatttctttcaagttggattttataaaaatatgttcttcgccgtaatcaacgcaccaagaacggtgaatatcccctcccgctaattctgttttattgtgaatgtcagcgtcaccaaaatgctcacttaatagacggttcactgcttgccacatgattcacctcattaagttgacaattgccatgctcatattacagacagatgtaacaattgaacaagttaaaaagtgatttaaatagcactcaatagagaaccatatccaaaattagatatggctctctactttattaatttgatttacctgaaatttatgataatggggatgggatatctctggtacgcttcttgctcattttctttctagctaattttatttggtcataaataagtgctgttatgaagaagatagcttgaataatgacgatacaaggccctgtttcaccatcaatgtgaaagctgattattgtaccgagcacactggatgacacagaagcaatcattgcaacaataagcatgcgatcaaaactccggcagagcataaatgcaataataccgggagatatcagcatggcaataaccaaaataatgccaacggcttgcagcgatgcgacaatagttaaggccagcagggacaataagccataatggataagtttcacgggcagaccgacaacgcgtgcctgattgggatcgaaacagtagagcataaaatctttacgtttcagcaacacaattgccagtgttacgccagcaatacatagtgtctgaatcaattcatgctgggtaatgccaagtatgctaccaaatagaatatgcgtcagatgctgatcggtatctatgcgagtaaacaggactaaacccagtgcaaacatgccggagaatacaatacccatgactgtatcctctttgattcgactgtgttctttcagatatccggtagcgaatgcgcaaaatatccctgaaagaaaagcacctattgcgagtggtattccagcgacaaatgctaatacgataccaggtaagaccgcatgggaaatggcatctcccatcagtgaccagccctttaatactaaatagcaggaaagtaccgcgcagactgcccccacaatgacagaagcgaaaatagctctctgcataaaatcatgcatgaagggttcagtaatgaattcaatcaatgtactcatgagcgtcctccttgagttaattctaaagattcttttttcgctcgtctgcgggacgctaacatgccatgtttgggggcaaagaagaaagccagtaggaaaatcacagtttgtagcgtgacaatcactccccctgttgcaccattgaggaagtaactcaagtaagcaccgatagcactcgttaatgatccgatggtgacagcaatgataagcaggtgcttaaaccgatctgtcaataaataggctgtggcaccaggagtaactaccattgcgatgaccagaatggcgccgactgtttgcaatgcggcaacagtacaggcactaagtaaggtgaagaaaatgatttttaaccgtagaggtgataaaccgatagaacgtgcatgggtttcatcgaagaaaacaactaaaagatctttccagagcagcatcaagataataaaggagacagcaataatgatttcgacttgcaaaacatcttcatcagaaatgcctaaaatattgccgagaataatggtttgtacattaacggaagtggggtttaaggaaacgattaataacccgacagcgaaaaaagtggagaatataaaaccgatcaccgcatcttcacgtaaccgcgtgatatgacgaaccagagtcattgataatgccgcgagcataccagtaaaaaaggctccacccgcataaggcaaaccgagagcatatgcgcctgctacgcccggtacaacagaatgggaaagggcgtctcccatcagcgaccaacctttcagcatcagataggcagataaaaaagcacagactgcacctacgatggcacttacccacatggctttcaccatatagttgtaattgaatggttgtagcagcaactccatcatggctgattttccttctgcttttggctttgacgtggtgggacatgacggtcatagccatagaagacagcagcccgttcatcatcggtaatgacagtcagtgagcgcagatcatcatcatcatgaagctctgagccagaaaggttgatatggcgtaaaacacccccgaatgttgtctccagatttttttgggtgaaagtggtttcagttgggccactagccaaaacagtgcgattgatcaagataacatggtcacaaaattcaggcacactgccgaggttatgcgttgataccaaaactagatgcccttcatcacgtaagtcacggagtaaatcgacaatggcattttctgtcttaacgtcgacaccagtaaaaggctcatctaacagtagcactttcccttcctgtgctagtgctcgtgctaaaaatgtccgttttttctgcccaccagaaagctcaccgatttgtcgatttcgtagttcattcagcccgacgcgttcaagcgctttatccacgatttgatggtcacgtttactgggtctgcgcaaaaatcccatttttccatagcggcccatcatcacaacatcggaaactaaaactggaaaattccagtctacatcctcagtctgtggaacatatgcaatgatattttgttttaaggcagtcttgatggtttgtgcattgagggtgacttttccgtgggagggagtaactaatcccatgattgttttgaataatgtggattttccgctgccattcatacctaccagcgcacaaattgtgccgccggtaatatcgaaactggcgtcatatatggcggtgtgcccattgttgtaagtgacggtagcatcatcaacaattaaatgaggatgctcaaatagtgattgatggtttaacgatgaatgactcattgattaaatcctttcgcgatggtgtccacagtggtgttcagcaggtcaatataagtaggcactggaccttttggggtagaaagagaatcgacatagagtattccaccgtagtgagccccggtttctttgctgacttgttttgctggtttatctgaaacggtactttcactgaagacgacagggattttctgtgtccttatggtatcaataacacggcgaacctgttgcggagaaccttgttcttcagcattgattggccataaatacacttccttgaaaccataatcttgtgtgagatagctgaaagccccttcactggttaccagccagcgttgattttctggaatacgggacaggcgttccctgagtggtgcatctagtttgaccattttttctgcgtaaatttttgcattgcgattataaacctctgcattcgcaggatcatatttaacgaaagacttacggatattttcaatataaatcagggcgtttttgggagacatccaagcatggggattaggatttttattgtaaggtccctcacgaatcggcagcggggttataccctcagtaatgacggccgtagggatgtctttcatgttttcaaaaaaacgttcaaaccagcgttcaagattcaagccattccagaggataagatctgcacgctgtgctttaatgatgtcttttggcgtaggctggtaatcgtggatctctgcgcctggttttgtgatggattcaacgatggctgtatcacctgcgatattttgagccatatcctgaataatggtaaaggtagttacaaccctgaattttttatctgcataggcttgctggctgaatagggtgagcgtgaataatgcgataatcatactgaatatcgggaaagcagaaattgaacgtcttttgttcattgtggcaaaccttacttgttacacatataattattgataatgattatcaatatcacttattcaaagtcaaggctatattgcacaaaattaatgatagtttgatagacattccttaactttcttgttgctgagatattggtaaagaaggtgatgtgaacaaaaaattagcctattgtctagacttacgtaatataaatggctcaatttattttgataagttgtataaaagtattttgggcttattagtaaagttatatatgatttataaaattaattttggtttggggaaggcagcgtgaaattaagactcggctatattgtgctggcaatgctattgacaggatgtgcagaccaagaaattcatcagtcaggagttggtaagcaactaacagcaaaacgcctgctcggtaacaataacgttgtttctagttcccgtaaatttatggctagatctgaatcaacaccatttgatcgttttattgagcaggctgcaagacgttatggcgttgatgaaacgcttattaaagcgattattcgggtggaatctggttttcgtccagaaatcgtcagtaaatccaatgccgttggtctaatgcaaatcaaggcatctacagcagggcgagatgcttatcgaataaaaggaaaatcggggcagccaactatgcgtgagttgaaagatccagaaaccaacattgatcttggaaccgcctacattagcatcctgaaaaagcagcatctggaaggtatcactaatcctgaaacgatgtactatgcgatgatagtcgcttatgttaatggtgcaggagcattattgcgtacatttgattcaaacagaactttggcaatcaataaaattaatcgaatgacaccaaatgagttttatcaatatgttcagaataatcatcccgcaccacaggctcctcgttatttatggaaagtaaaaaaggcctaccgcgatttggatatcattaataattgatatctattaatcaatagattacacggtaactttttattgtatgttttcactcaatcatttgcgcagggaaattcccaagatttggttaatgaaaaagagcacggcgcgatatagaacgtggaatgtatggtaagaaaagtttaaaaaatcatcagccacaatgatgttgtctcgaatgaggcaagttttttcttattgcattcgtataggaaaattaaacagcaactcctagctggcaagaaaacggtggcaatctgtccacgctctttggcctatccaactgaagtccggaaagtgatttatatgatgaatgccatcaaaaaacgtaaaatatttccctcggatatagaggaaatcaccacggttgccgcaaggtgtgatatcccatctcaagggcaggtttctgccctgtagcgacagtagcttcctttcccaccattccacaatctcctgcttctctttcaggtagttgtctgctggaaatttatcaaagttgtagtaagtggaaagcatgtctaatactatagaaacaactatccgagtaaaggatgtttagagatttttattgtttgtacataattgtgtacattattatattttctagctttaatggctgcgtaacgtaatgtatttaaataatattttgtcttctggttataattatcagttgattacttccgatgctcaattgcagtcaatctgtgagcgggcaaaaaaacacgcaacaattgcattagatacagaatttgtacgcacacggacgtattatcctcaattaggtttgatacaactgtttgatggagaacaactttctctgattgatcctctcgatatttcagaatggcaaccctttcgggagttgttgactgatcgagatgtattaaaattcatccatgctggtagtgaagatttagaggttttttggaatagctttcaatgtttgccaacgccgatgattgatactcaggtactggctgcgtttattggtcaccctatgtcatgtggttttgcaacactggttgctcaatatctgcacgtagaattggacaaaagtgagtcccgcactgattggttggctcgtccattgagtgaaaagcagtgtgaatacgccgcggcggatgtttattatttattgcctttggccgatattctgatggcggcaacggagcaggcgggatacatgggtgcggcacaagatgaaagttatctgattgcccaacgccgcaaagaaatcttaatgccagaatgtgcttacaaagatataggtaacgcgtggcaattacgtccaaagcagctggcctgtttgaaaaaactggcgggatggcggttaaatcaggcgcgtgagcgggatttggcaatcaattttgttattcgcgaagaaaacctatggcaggtagcccgttatatgccgacttctttgggggagctggatgccttaggattaagtgggcaggaaatccgttgtcatgggcgtcgtttgctggcaatggttgcagagagcagagatattccagatgaagcctgtccggctctcattacaaacctgattgattatccgggctatcgtacggccttcaaggaaattaaatcgctggttactcaaataagtgagtcccatcagtttagtgtggaattattggcttcccgccggcagatcaatcaattgctcagttctcattggaaactgaagtcacccgattatcagcctgaattactccgtgggtggcgaggagagttgctggctgagcctgttgctgaaatattagcaaactatccggcttaataacgattattgctgtgatgtttattccctgcaccgtacgatgggcagggaagattgaagttaactttgtgtcatcacttcagcagcggtatcatttttatcctcactgatactgaaccatggataatactgcacccgactcagccatcccttggcatttatcaccaatatttctcgaccaatcggatcgtaatagtgagtattggtatacatatgattgcgaatactatgacaatcaagctggcattaacatccggcgtcccgcattcaatgcacccacaccataaggctctgtcgcattaaaaaccgatatcgggtaacctacgtacttttatcgagtcagttgcccatgtctttaattcgaaaagccttcaaacggctacactatcctgtcgatattatcgctcaatgtgtccgttggtacctggcctatgccctgagcctgcgtaatttagaggagatgatggctccgagcgtggcattgaggttgaccactcgacactgcaccgctgggtaactcgtttggtgccgttattggataaagcctttcgccggtacaagcggcctgtcggacgtcgatggcgaatggatgagacgtgaaaggccagtggaaatatctgtatcgagccgtcgatacgaccggacagaccatcgattttctactgacggcaaaacgggatgcgcctgcagcattgcgcttctttcacaaagcgatacgccaccacggtgagcctgaggtggtgaccattgataaaagcggtgccaacaccgcggcgctagacaagctcaacgccgataagccggaagaagaaatgataaccatcagacaaaacaaatacctgaacaaccttgttgaacaagaccaccgcaatatcaaacgtcggacaggctctatgctcggatttaactcgtttcgtcgagcccaaaccctgttagcggggatcgaagtcgtttcgatgttgcgtaaaggtcaatatatacaacccaaagataatacattatctcccacagagatgttttaccgtttggttgcctaaataataaccaatcccactttcattcaaactttcgctgttaattcgacagaatccttatttgcaacagtgccctatttttaagtgtgtaacataaatgttgatatttttttaactttgaattagtttacttggaacgatcattccaaaaggtatataaaatatgcgaataaaggaatttgacaccgataaaattgtagatgctgcgatgcaggttttttggctacggggttatgcaggaacatctatacaggatttagttgaagggactggcttatcgagaagtagtctatacaacactttcgaaaataagtatgggctttatcagaaagcactggaacattattctacaatcacatcagctaacgtagaacttattgcgggagaaggaaccgctaaggaattaattcgcaaactactttcaagtattgcggaggatgagttatctgactctctaatgcgaggctgcatggttgcaaatgcatcattagaattggccggacatgatacaactatcgcggaattggttctatacaacttgaaacggctacagaaggcacttgaaaagcgcattcaggcaggacaacttgcaggggagatttcaaaagaaaagaatgcttctgctttagcatatttttttgtaaacacaatacagggcataagaataatgggcaaaggttgccctgttcaagagcgtcaacgctgtttacatgatgtaattaacattgcattggaaacattgtaattagcctaccgtagtatgtaggctccggtttttatttactccattttggaacgatcattccaaattaatatttaaaggaaatttttatgactacccaaaaacagctcaaaattgcagtgctaggaactggcttaatgggagcgccaatagccagaaatctacagaaaaaaggatttttagttcatgcatggaatcggacgataacaaaagcactaccgcttcaagcagaaggaattcagatttttaatacgcctgcggatgctgttcgtgacgcagacataatcatcaccgttctcaaagaaggaatgaacgtacaacaggtgttagaagaggctgtatcggctattcgtaaaggcgctattttgctacagctaagcactatcggagtcgaagcggcaatttctttagacgctttagctgaaaaaataggtttgatttactacgatgcacctgttcagggcactaaacaacccgctgaattagctcaattggtcattcttgcctctggcccgatggataaacgtactgaagttcagcctgtttttgatgctattggtaaaaagactatctgggtatcagagcaaaagggatcaagcagttgcctcaaacttgccttaaatagctgggtattttcattgacacatgggattgctgaaagtctgacattagccaaaggtttagggatcgacccacagttagtcgtagatgtaattaaaggcggcccaatggatagcgtatttttccaaagcaaggctgctgccatgttatcagatgattacaccgtaagctttagcattgaaaacgcagtaaaagatgctcaattagtcgttgatgcggctaaacaatttaatctacaaattgacggtgcaaatgtcagtcttacccgatttgaacatgctcttaaaacgggtcatggcgacaaagatatggccgcaacctatataatttaattgtttgagagcgttaatgcatgagtaatctaaatcaagtaaatacagcatttgaatatgatgtaaacccgaataggctgcctatttggaaattattggcttttacaatggctggatttttaaccattttaacggagactatacctgctggattattaccgcagattagtgaagggttaaatgtatccgaaattcaggctggtcagcttgtcactttttatgcacttggttcggtcttagcggcaatacctgttgttgctgtaacgcgtaatttaaatcgtaggtttttgtttttatttgcgattagtggattattagtattcaattcaattactgcaatatctacagattacgttcttaccttggtggctcgttttatcgcgggtatggcggcgggcgttatatggggattatttgcaggttacgctcgtcgtttagttcctcatcgcttacaagggcgtgcgctggcaattgcaggtgttggtcagcctattgcgctatgtattggcgtaccgctgggaacaatgttaggtactctattcgattggcgcggagtcttctggattatgtcagtaatcgctttgctattattgatttggatccgactcgcaatacctgattttgcaggacaatcaagtcagcaaagattatccattcgtcgagttattcttttgccgggtgttcgttcagtattagtcatacttttcgcatggattttagcgcataatattttgtacacctatattgctccttatttaaccgcatttggattgagttctagcattgatgttgtgttactcgtgtttgggatcgcctgcattataggaatttggttaacgggattatttgttgacagtggcgtgaggatattgactttactgagtcttatcttgtctgttatagcatcgctgttacttattttatcggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcgtaaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgacccttttgcgtgccagtcatgcgtaccaaaacagcgtaaccctttttccgaatatccctgtttacgtggcatcgattgagcaaaaccactttcatccaaataaacaatgggtctgccagtctgttcatcatcgctgatgcgctcgataaatgcctgacgagcttgaggatcagcgcgagggtgttggagcgtttttttcggggtgatccgaagccgtttcaaggcgtaatgaatagccgattgtgagacacctaaacgttttgccctttcccattgatagtcatcagaaaaattttggacatccgcaatgagtacctcatcagggattttcgtggcgggtttatcgcgggtcatgcaaggttctattttactgcaccaccggaacaaggtacgaatggagatctcaaaatgggcactcgtctgttcgaaagtcaacgaatgcttgtctttgtatgccagtactcgctttcgaaaatctaagctgtagcccatctcattttatgccttgttatcttagagttagatattatgtcatattaatatgatttagctatataattccctctttaaatcatagttcaacgtgtttttctgtcacatgaaaattaggttcggtcgcgttgagcaagtctactgcaacactaattggagggttttcgaatgcacatatcagaggtttcatcacgcccgccttataacgttgtgccttaacaattgaaggtgatgaggcaggcagtaaggcgcactacttttctccccgtcggaatagactcatcgaatatcattgtgctatagcgggtagcttttgtccaaagtctaattgtgccgaaatagaacaattaaacattatcaacaagctagggtgagttaacgctaactcattggtaatcttggaaacctcaaattgaggaagctggacagaaagaaagaagatcaccgaggataaggtaaggcataacttgctgaattaaccttatatattaattatcacttttacagagcgatgatcaagatataaggttaatcattaatagttcttggatgtaacactgaagcaaacaccagaactgatgatacaaagaggagtattaaaggaaataaattaaaaactccataacgaattaaaggtggtttcacataataatctaacagcacccggagaattcatgaaccctgtcatcaatcttaaaaatcttactctcaagccttggaagcagggcgaacgttatgagggatcagatatttcctttggacaacagcttgatctcaagcatttaggcatctcctataacgaagtgccgaaaggtaaaagtagctgtccgtttcacaaccatcatagtgtagacgagcttttctttattcttgaaggtaacggcacttaccgctttggctccgatgaatttctggtcaagaagggtgacgttgtaggcgctcctgcgggagggcaagaaactgcccatcaaataatcaacaccgggtcagttccattgcgctatcttgctatgtcagcgaatgtttcagcagatgtgattgaatatccggactcaggcaagtttcagtctgtgttaaagcaacaagatggaaagttgtttcattttgtcggacggctcagcagcgaagttgattattgggacggagaacctggagcataacaaccagaagtggctgcggttactcactccagttacatagttaaccagaattcagtaagttacggcttggcatagctacagcggcggttactatagggttgctaaattcatcgtgttactttctgcattagggttaggggttgccagagcctttaatccatttccaaagattgacaaattagaagccccgttggttgccactgtcggggtttcgcttcttataccgcacctaaccaaactccctatttcagggtatttgaattttatcaatgagttactcttaccctgtgagctaaaccctgaaaagggcttcgtattgcccgtaatacctgagatttcaccctgtgggctgtcggagccgttcgcgcaggttgtcgggcaatgaaagggctttcgtttattaaactctcaatgctgaactggacagattcattctgttcacttggaagccatagattaggcctatttctaacttactccattggaggtagttagaaagtctgagatattgcgaggagtgtttaattgctgaattgggttaattccgtgtgctgtacgggatcactttgatggtgggtttacgggcaagatgtagatatgcagcttggcggcgatgtgcgagcatggtttgtagcactcgtttatgcaattgagtgtacaataattttatcacatggccttgcaatcgcccctattccatcacggttaggccaatatttttccttaaaccatgttctaaaattatggcctgtcgggaaatggacgcaaccaaaattaggatcaaaaaaatcaataccattggcagttactgcgagtccaatagcatgatctccatacgccaaaacgtcataacccttatggatagtggctaagttttctacaatactgcccccaccataacagcttacatgcctataagataatccgttttcattaagaaatagaaggccatccatgcttttcgctttaagattttcaactatttttatataactaggtagtcttatatttcctaggaataagtgagactttcctaatttgtgcatctttacccaagccattaccaaactactacagaccccattttgcatagtcgaagagaacttaaggggaaaattcagagtttgattgaagcgaaatacccaatttccttcaaattcatcagcatctaataacgacatttttaaatatatccccattcactatgagtttagtttacgccaaaaaagttaaagataaaaatatgttaaaaacagagtttatgaatactacctaatgtaaagggttttaaaagaaattttaaagactctgaacaagctctatttattccagtgaattaggtctattccggtaaaacgccggaattaaacctaaccttttgatattattagaaacctcactctgaggaagccgggcgatattggaattcccatatcggctaaaactctgcgtttcaccgtatttaagttttatcaatgggttatgcggttgtgtaaagattttacgcgaccctgcgggctaagcccgttaaagggctttgtattgcccgtagtacctaagctttgcccctgcgggttggattgaccaaaggcgggatcccgccttaacccgacaggacaaattcgtccagttaatgccatttgcgagtaaataatatttacgcacaaccgctaaatatggcggtagccgttcgcgcaggttatcgggcaatgagagggctttcgattattaaactctcaatgctgaactgcgcttttctgcatagttaccgtggaagccataaatgaggtcaatttctaaaggctcgtcgatcacctccaggcacccgaggataaaactttcagccaccagcattcgctttctgacttcgctctcactgagcttgaacttgcggccaattgcacgtttggatatgcctttaacgtagtggtcttcaataaagtcacattcctgagacataccgacgttacgtagcttggcaacgtagccatcgatgaccatgccgtcctcgtcactgcacgatagcttgtcactgcaggtataagtcaccgcgttttcaaaccctgcggaaacagacttccagccaatgttaaccctaccttgcgctacccacctgccccaatgcgatagtattttttgcatgtctctatacatggtttttttatccgcctcaaatgtacttgttaactagtacacaatgtcatcactggtggataaggggaaatgtggccaagagtagatagtcaatattttgaccatgatacaaatcaaggcgttgggtgcatgcccctttttcggacgataatgattttaaaggactttttcaatttcggcgaatcgacggaattaagtttaatcaagaagttaccggggagtttctcagtcatgcgttatgatcgcgtttttgcttcatgaatcaaagccccaattgggctttgccctgccgtcaggtgggtcgttaatcattaagttacatgagggaaaatcccgtatgtacaaaagcatcaactgcaaaaaaattttcagttgtgaaaatttcacatgagcaaaaggtatgcgaaaaatttctcacaccctcacctgtgagtataaaaccaaagtaggtatacagggcttgaagctgatatctttgctcgggagtcaactgtcggtactgtctggtttgtttatgcatatcaggccatgatttcaggtgtgagagccatgaaatgtatcacagttgactcactcctttgaatatcccgccgattgcacttaatatgttaactcagctgtcatggctaatacaggcagacggcgataacccggcgcggtgaaatgcagatacaaaaatgccaccagtgttaactaatggcatgagggattcctttaaccgctcaaggggatgggtaaagaaatattgactttagtttcaaaggttaattatttattaaaaattattcgcttgttattatatacgcaattaacttgaagaggcgggttttaaaatctggaagttatcagtcaaccgagtggtgagttctttcgctttttctggcaatgtgacatgaaaaaagtagcgcagcgtttcacggaatgttttggtatccggaaaatagacattgtttcgtacctgctcattcacatacttccataatctctatatgaacgcatcccattcgcaagacaaaaatcacgttgacacaggcggtaggttgcagctctatattcggccttattacagccgcagggctgtgggcctcgatgtaatccgctggcttgttcctcattcaatcaacgatctttatgatcacgcgattattcaggtttagcaagtcacggtcttacctgtctttgtcatcgttgctctttgactcagcaatctttctgcattcatccttgtcgttaaatgtgaaagttgaccagtaaaacgattcaataaggcctgacgctgacgtaatcttgctggtagtcccgttgatgggcgaccagtgcccagaccgttcgagccagcttattggccattcctacaacggctacgcaaaccggacgtcgtttttttaagttccgtcacccagggcgacggcgttttcgtgagtaaggtggccgttcttgcaccgtggataccactctggcgtttacaactcagtgagaaagaacgggaatatggccattatctgctggttcgtcgcagccgggatgaaaaacaggaacgggcttactatatcgtgtatgcgcgcagagaccaggcggctctgaaaaccctggttcaggtggcgggttgtcgctgggaaatcgaaagtggctttgaggaaaccaaaggggaatgtgggctggatcactacgaagtgcggcgatggcagagttggcaccggcatattaccttgtcgttactggcccatgcagtcctcgcggttctgcgggtacaggagaaaaaaaacaccggtaggccgggttccgctcagtgtagcggaactccgtaagctgctgtcaaaactgatggaaaaagcaggaaagacaatcgaacagattttccattggtcagactggcgacgacggcatcaataccgggcacaacaatgtcattatcgtcgccgggcaaatcatcggcttacagagcaattacggctgtagtactaagtaacctgaactcgggataagaaaaacaaaaaagaagggaactaaaagcgggttctgtgatcagatcttttgaccaaaaaagaaacttttcactgaggaacccgctatgcataatttagttgacttattttgtcatgtcgatgatttttgcaaattgttcatgcctcaatggcaaaaatatctgattgaaagtggtcaacgccagcggttacgcccaacaagaatgacaaccagtgaaatcatgacgattatcattgccttccatatgtcccatcagcgtgattttaaacatttttatattgggttcatgacggtataccacaaaaaagactttccctcattattgagctacacacgttttcttgaggccatgccgacggttttggctccattaagctccttctttacccacctaaaaggtcagccaacaggcctcgaattcattgattcaacccgcattaaagtgtgccataacctgcgaataccacggcatcaagtttttaaaggggcagcagctagagggaaaggaacaatgggatggttctacggatttaagctacacattatcgtgaaccatcttggtgagattgtcgccgcgaagctcacgtcagccaatgttgatgatagaaccccagttaaggcgttctccaaggggcttttagataaactctatgcagacaaaggctatataagcaaagccttaacggaagagttagaaatggaaggcatcacattggtcacagggcaacgcaaaaatatgaaacccaaattattagcggcttgggatagagcgatgctcgctaagcgattcattattgagactattaatgaccaactgaaaaatatcactcagattgagcattctcgccatcggagcttacatggcttcatgttgaatttgctgggcagtttgattgcctattgtttgaagccaaaaaagccatcactgaatctctcaaataccgagaaaacaggacttcaagtaatggcttaaaccgatctcaggttaattaggataaagcgtcagattgatacctggtttaatatctttgattctgatgcttttattccagctcatcaggtcgttgaggttgacgccgtggtgtttggcgatgctgaaaaaggagtctcccttacgaacctgatatgtgataggaccactgctattaattttcaaaacttgcccgatcttgagtcgatctacagttttcaaactgttcaatctttgtaattctcggtgagatgtcttgaaacgttttgcaatggcggacagcgtatcaccagaacgaaccgtatattggctttgttgcagtagctggcgagtattttgagcaacagccagacggatatccttcaaaactttttcatctgtcagcaagttcttaaactgtttgacgttccttttgggcagcatgatgtaatgcggcccatcaggggatgttatgccctgcttataaccagagttatatgccctgattgatgtcagggacagcccagataactctgccgcttgtgacagcgtgatctgctgaccaacctcaactttagcaagtgcctgctgattgttaggtcgcggcagcttcaagctaaacttgtcgttatggcgaatgatattgctgagagccactatttttggaacatactgcatcgtttcccgtggtagcgacaaagaccaaaaatccgttggtttgcccttagcctgattgtctctgattgcacgtataacccgaccttcgccgctgttgtaagccgcgatagtcaacaaccaatctctgttaaaccgtgcattcagatactcaagcatctccagcgctgctgtcgtggatgcagccacatcacgacgggcatcgtaccatttattctgtgtcaagccataatggtggcctgtactcggaataatctgccataagccagccgctttggcataagaagtggcatgaggattaaaagcactctccactatgggaagaaaaactacttccattggcatatgccgttgatcaagctgatcaactatccaatacatatacggttctgcccgtaacatcacattttggagatgactcttgtgtttcagataataattttgttgttcacgcaccctgttattgtcaggaatttccatcttcaactcatcacggatatgtccccacaaatcttgttgggttgtcggactctccttccagtttgcagtatcctttggttctgcaataccgtctgtctgctgattcgtcgaagacatcttctgtgtattttgctgggaaggggtttttaattgcagacccgattgacacccggcaagtagaacagaggcgaacaagatcgcttttgtcttcatgttctctttttatgtttgcctaaaaggtgagcgatcatactgacctattacgcagaagacaacccaacaaagtcaaaatcgatctttataaattcttaattgctgaaaaacagaagaaagtggttttgaattaggtttaatgccgatatttttttgtaaatcaatgttgtgacaattcaggaaaacgttaacttttttctctatttgtaaagttgttggtactgttggtttattattttcgcgaatacttattattttattataataatcatgaatagtttcattctcaggcaaaactgcccgtgcaaatttcatattggcggcagtatattcgtgagcacagcagattaaagtctcatccggcaatgacatgattttctcaagagaagaaaacatttgttccgctgtaccttcaaataatcgaccacagccaccagaaaacagagtgtcgccacaaaacaaatagggagcctgatagaatgcaatgtgacccagggtatggccgggtaactccataatgtggaaacaataatgacctgtctcaatggtgtcatgttcatggacaatatgagtggtgcctttgctccgggtctcttccggaccatatacgggtaagtcggcatattgtttaagtaggccagccacgccgccaacatggtcgtggtgatggtgagtcaacaggatagccgcaggaatgagttggttggccgctaagatatcaatgacgggctgtgactcagatggatcgacaatgacacaatgtttgtcttcatcacaaagtaaccaaatgtagttgtctgaaagggcagggatcctgataagctccattatatgcctcatatttatagtaggttgaaaggaagatgacatgcaatcagcgcgttcaatcaagcaaataacatcccctgcttcttgggctgagttaccgtggggagagtattaccgcgtcgctctggaacgtcaattggaactgtggtggccgaagatttttgggcttcatttggcgaaactgggtaatctgagtgcagaaattgacagccgtacctgcccgatcagtcatcagttcaatatcggcttaatggagggaagcatggatgttattgctgatccttactgcctgccttttgaagctaaatctgttgatgcctgcctgctggcacatatgctgacttacagcgctgatccccactggctgctacgggaagttgaccgtatcataactgatgatggctggttgattatcagtggttttaacccgatcagcctgttgggattaagaaaagtgctgttgccgatacaccgccgtcaggcttatgaggctcaaatgttttccatgcttcgccaagtggattggttaagtcttctcaactatgaaattgttcatcatgtcagttttcatgttttaccgtggcaaagcgggaaaagtttttgtaatcgttctgcatcgatgtttggctgtatgaatatgataattgcccgcaagcggacaattcccctgacattaaatcccatgtgggcgacatcgctgaagccgaagttcagaaatgtattgggagcggcaaaagatcttcaccgacgccaataatttttaccaaaatccgctgtaaaccctcgcattgggcgagggtttacagcgcaattgttaatttgcactttcagtataaccattatcaggcaacgtgggtgaattggcggcggtacgagccaattcatcacactgttcgttttctcgatgtcctgcatgccccttgacccagcgccaatcgatatcatggtctgctatggcttgatccagtcgctgccagagatcaacattgatgacgggggatttgtcggcttttttccagccgcgttttttccagttgtgtatccattgggtaatcccttgacgaacatactggctatcggtagtcaggatcacattgcatggacatgtgagcgattccagccctgcaatggccgccatcaattccattcggttgttggtcgtacgaaaatagcctttgctcaaggttttttcatgctgctggtaacggagtacaacaccgtacccgccgggtccgggattaccgaggcaagatccatcggtgaaaatttctacctttttgctcatatttggtagactcttcctatatcaacttcaatctaaactctaagtctgacacaaaaaaacactatgagcactgcaattacccgccaaattgtcctcgatacagaaacaaccggtatgaataagctgggtgttcactatgaaggacacaacattatcgaaattggagcggtagaagtgatcaaccgtcgtctgacggggcgtcattttcatctctatattaaacctgagcgtctggttgatcctgaagcgtttgaagttcacggtatcagtgacgaatttttgcaggataaaccaacgtttgccgatattgccgatgagttcatcgaatttatccggggcgccgagctgattattcacaacgcgacgttcgatatcggctttatggactatgaattccgcaagcttaatcgtgatatcccgccaaccgcagatttttgtacgatcacggatagcttggtgctggcaaggcaattgttccccggcaagcgaaataaccttaatgcgttgtgcgaccgttatcagatcgataactcgaagcgtactctccacggagccttgcttgatgctgagatcctgtctgatgtctatctgacaatgacaggtggccagacatcgctgaccttttcgatggaaggagagatctcaggtggcgctcagatggcagaaatccagaaaattacgcgtccccagacgggattgaaagtgatctatgcttctgatgaagaattgcttcaacatgaatcccgcttggatctggttgaaaagaaaggtggaagctgtctatggcgtccgaaacctgaacaattacagtgataggagccgcaataagattaagtaacttcgtcattaaggtgaaaaactgtgcaagtgcgccattttgttataaaaagcgattgacggattatgctgaggctcgtattatccaccccgttctcaaccagaacagcatgcggtgcggtagttcagttggttagaataccggcctgtcacgccgggggtcgcgggttcgagccccgtccgcaccgccagaatctataagccctgagtttttaactcggggctttttctttttccggttactctcagctacagccagcaaaatagccctttcttgatgactgatcacgaccatgcaggcactggttgaaatatcgttatgctcaagtgttgactgaattttgaacgtacaatacattgtacagataatccttgtgaatgagtttaccccctcaaaaagctgaaattggatggtcataatgaaagtcttaacatatagcgaagctagacagaatctttctgaaaccatgattagcgtggtcaacgattgcagccccgccattattacccgaaaaaacggtgaaagttgtgtgttgatgtctttgtctgattatgaatccttacaggaaactgcatacttgatgcgttctccaaacaatgtgaatcgtctaatggactcaattgcagaattgagagcaggaaagggtaaggctaaagagttggatttagattaatgaaaattactttttccgacagtgcctgggaagattatctttactggcaacaaacagataaggcaatactgaaacgcattaatcaactcattaaagatatacgtcggcagccttttgaagggattggtaaaccagaacctttaaaacataacttgtcagggttctggtcaaggcgtatcactgaggaacaccgtttgatatatgctattgaagaagatcaaataatgatagcagcctgtcgttatctttattgaaagatgtctgagtttttaactcggattttttctttttccggcaacgaccaaaagcctcaaatcagcttataaaaaaatgtagttcccgcgaattccccgctggaatttaatgcaaactgtgggatctgcccggcttcaataaaaccgcattttcgatagagtgctgacgcggggtcaccagtacgggtatctaataccagcaaacgacgctgatattgccttgccagccgttccagtgcattcactaacattcggccaatgccgcgctgacggtaagctgtatgcactatcagtttttccacttcggcacggtgcaggctattctttttctggcagaaagaaagttgtaccgagccagcgagttcttctccctccagagctatcaacagcacgcggctacccgacaccatatctgcttcaacattttgccagtattgctctgcttcgttcacatcaagtggagcaataaaaccgatagaagcatcactttcgacacaatcatgcagtaagttaataagctcatcacgttttgcatggatagaatccaatagtatgatggccggaattgaggttgagtcagatgtaagattgaattttgacatttattattaagtttgggatgagtaatgaccaaatactatacaaaatcatcaatatttcaattcaaataagcctcaatatcaattaaatatcattatcctcataggcaaaaaactcgctctttttgccttgatcaacctataaaatatcatgtctaatacgtgacttccctttgcgcaagtcacggtatgaaattatctcccatttgcgcaaatgcaccttcagttgtacaaattgatctgaaaatttgtcataacaacgggataaatcaaagaatttatgccagaggaaaattaagattgtttccgttatctggcattaatgattgcggtttgtatgccgcgctgcgaaaattagttcttatgtacattaacgctttcatccgacttggagtaaagaatgaccactcgtaaaacccttgctaatgctgtccgcttcttgagcatggatgctgtgcagaaagcaaaatcagggcatcctggcgcaccaatgggaatggctgacattgccgaagtgctgtggcgcgactatttgaatcataacccggtgaaccctaactgggctgatcgtgaccgtttcgtattatccaacggccacggctctatgctgatttacagcttgctgcacctgactggctatgatgtttctatcgatgatctgaaaaacttccgtcaactgcattccaaaacccctggacacccagaatatggctatactgcgggcgtagaaacaacaactgggccactgggtcagggcgtcgccaatgccgtgggttttgcaattgcggaacgtacactggcagcacagttcaaccgtccgggtcatgatatcgtcgatcaccacacttatgtattcatgggtgacggctgtatgatggaagggatctctcatgaagtctgctctttggcaggtacactgaaactgggcaaactgattgcgttctatgatgacaatggtatctccattgatggtgaagtagaaggttggttcactgatgacaccgccgcgcgctttgatgcgtatggctggcacgttatccgtggcgtagatggtcatgactcagacgctatcaaagccgcaatcgaagaagcacaaaaagaaacaggcaaaccttctctgctgatgtgtaaaaccatcatcggttttggctcaccaaacaaagcaggcaaagaagagtgtcacggttctccgctgggtgatgcggaaatcgaagcgacccgcaaagcgttgggctgggaacatcctgcgtttgacgttcctcaggatatttacgctggatgggatgctaaagcagcaggtaaagctaaggaagcgacatgggaagaaaaatttgccgcttacgcaaaagcacatccagaactggcagcagaatttaaccgccgtacccgtggcgagctgcctgcaaactgggaagcagaatccaaagcattcattgagaatctgcaacagaacccagcttctattgccagccgcaaagcatcacaaaatgcgctggaagcattcggtaaagttctgcctgaatttatgggcggctccgctgacttggctccaagtaacctgaccatgtggtcaggctctaaacccctgaatgaagttcaggacggcaactatattcactacggtgtccgtgaattcggtatgtctgccatcatgaacggtatcgctctgcatggcggttttgtgccttatggcgcgacattcctgatgttcgttgaatatgcccgtaacgcggtgcgtatggctgcgctgatgaaaatccgcagcattttcgtatatacccatgactccattggtctgggcgaagatggcccgacccatcagccggttgagcaaattgccagcctgcgtgtgacgccaaatatgagcacatggcgtccatgtgaccaggtggaatcagcggttgcgtggaaatatgcgattgaacgtcaaaatggcccgactgccctgatcttctcccgtcagaatctggcacagcaggcgcgtacggctgaacaactggcgaatattgagaaaggggcttatatcctgaaagattgtgcaggccagcctgaactgctcctgattgctaccggctctgaagttgaactggcggtgaaagcggctgaccaactgagcgcagcaggccgccaggttcgtgttgtctctatgccatctactgatgcatttgacaaacaggatgccgcataccgtgaagctgtattgccagccgcagtttctgcccgtgttgccatcgaagctggtatcgctgattactggttcaaatacgttggcctcaacggtgctatcgtgggtatggaaacattcggtgaatctgcaccagctgatcttctgttcaaagagtttggtttcaccgtcgaaaacgtggttgccaaagcaacatctctgttgaaataatcagcaaacgaaacgataagcgcattcgcatcaatatctgagcgaatgcgctctttttttatacaatatttacttcgttatctcattaatgactcttgccattgcgctttttttctcgtaatctgcgtctatattagctgaaccgtttcagttttggcgcgtaaaatgtcttgtctgtcacaatctgattaattttgtgatgaatcatccgtacaatcggcagttgctcagttatcctaagcggttgcatgaccacagagaaattcagggagtaacatgacaatcaggatagcgattaacggttttgggagaatcgggcgcagtatcttacgtgctctctacgaatccgggcgtcaaactgaaatttcggtgatcgctattaatgagctggctgatgcggaaggtatcgctcacttattgaaatacgattccagtcatgggcgttttgcatgggatgtacgcctgaacaacaacctcttgctagtgggggatgacagcatccggctgtttcatcaaccggatatttcagcgttgccgtggaaagagttgggtattgatatcgtacttgactgtacgggcaaatatggcgaccgggcggatggtgaagcacatattgccagcggcgccaaaaaagttctgttttcccatccgggagggaatgatctggatgcgaccgtagtctatggtgtgaatcaccatgagctggtggcggaggattgtatcgtttccaatgcatcctgtacgacaaactgcattattccaatcatcaaattattggatgatgcattcaatattgaatctggcacggtgacaactattcatgcttctatgaatgatcaacccgtgattgatgcttatcacagtgatttacgtcgaacccgggcagccagtcaatccattattcctgtcgatacaaaactgtctgcggggattacacgtatcttccccaaattcagtgatcgttttgaagccatctcggtgcgagtgccgactatcaatgtgaccgcgattgacttgagcgtgacagtcagcgccgcagtggatgttggggatgtgaaccagctactgcaagaatcagcgggaagttcgtttcgtggtatagtggattacactgatttaccgttggtttcaacggattttaaccacgatccccacagtgccatcgtggatggtacacaaactagggtcagcgggaatcacctgatcaagaccctcgtgtggtgtgataatgagtggggctttgccaatcgtatgcttgatacgacgctggtaatggctgctacgggtttcaaataatcttctgttgtgccggatgttacttggacaaactgcacacagcggaggattgagcaattttatagagaattaatgagaggattcaccatgtctgtaattaagatgactgatttagatctggcgggtaaacgcgtactgatccgtgctgatctgaatgtgccggtaaaagatggcaaagttacctctgatgcacgtattcgtgcgtctttgccgacgattgtgtctgcgttgaatcagggagccaaagtcatggtgacttctcacctggggcgcccgactgagggagaatacaacgaagagttctcactgcaacctgtcgttgattatctgaaagaaaaactttcatctcctgttcgtctggaaaaaaattatctggatggcgttgaagtagcggaaggcgaattggttgtactggaaaacgttcgcttcaataaaggtgagaaaaaagacgatgaaacgttatcaaaacactatgcagcattgtgtgatgtgtatgtgatggatgcctttggcaccgcacaccgtgctcaggcgtccactcacggcgttgctaaatttgcggcaattgcctgtgcgggtccactgctatccggtgaactggaagccttgggtaaagcgctgtacaaccctgctcgcccaatggtggcgattgtggggggatccaaggtctcaactaaactgactgttcttgattcactgtctaaaatcgctgaccagctgattgtgggcggtggcattgccaatacttttgttgccgcagaagggcataatgttggccgttctctgtacgaagatgatttgatccctgaagcgaaaaaactgctggaaagctgtgatattccggttcctaccgatgttcgtgttgctactgaattctctgaaactgcggaagcaacgctgaaatccaccagcgaaatcaaagacgaagagcaaatcctggatttgggtgatgcttctgcagaacgtctggttgaaatcttgaaagatgccaaaaccattctgtggaatggtccggtgggtgtttttgaattccctaatttccgtaaaggaaccgaaattattgctcgtgcgattgctgaaagtgacgctttctcgattgcaggtggcggtgataccctagccgctatcgatctgttcggcattgctgataagatctcttacatctcaaccggtggtggtgctttccttgagtttgtcgaaggcaaaaaactgccagccgttgtcatgctggaagaacgtgctaacagtaattaagttgtgataacgagcagcatttgctgcctgttcaatgtcaatacaggaccacgtaacatgtctaaaatttttgatttcgtaaaaccgggtgtcatcactggtgatgatgttcaaaaagtctttgctgtcgcaaaagaaaacaacttcgctttaccagctgttaactgcgtcggtactgattccatcaacgcagtgttggaaacagcggcaaaagtacgtgctccggtaatcatccagttttccaatggcggtgcggcattcgtagcaggtaaaggcttgaaggcagaaggccagcaggcggcgattctgggttcaatttctggtgctcatcatgttcatcagatggcagaatactacggcgttcctgttatcctgcataccgaccactgtgcacgcaaactgctgccgtggattgacggcctgctggatgccggtgaaaaacattatgtgcagaccggcaagccgctgttctcttcccatatgattgacctgtcagaagagtctctggaagaaaacatcgagatttgtggccaatatctggcacgcatggcgaaaatcgacatgacactggaaatcgaactgggctgtactggcggtgaagaagacggcgttgataacagtcatctggacagctcttctctgtatactcagccagaagacgtggcttacgcttatgaaaaactgaacgctatcagcccacgtttcactatcgcggcttctttcggtaacgttcacggtgtctataagccaggtaacgtcaaactgacgccaaaaatcctgcgtaactcacaagactacgtgtctgagaagttcaatctgccacacaacagcctggattttgttttccacggcggttccggttctaccgcagaagagattcaggaagcggtcagctatggcgtagttaaaatgaatatcgataccgatacccagtgggcaacttgggaaggtattctgaactactacaaaaagaacgaaggctatctgcaaggccaattgggtaacccagaaggtgcagacaaacctaacaaaaaattctacgatccacgcgtttggctgcgggctgctcaggtttccatgatcgttcgtctggaacaggctttcaaagaattgaatgcggttgatgtgttgtaaaaatcgttattgtagaaaattacaataatcaatatgattattactaaacctgataatcagatactcaacactgaatttttcaaatagtacaagagctggctaaactttttctgggttagtcagctcaatattaatgatacaaatttaaaattcagctatatctgtgtttaggttgatagctactccatttagcctcagagaatacttcgctatgaggtacggctttcccatctcgccaaaattttaaattctctttcacttctttggtatctttatggcgatataaccagcgtaattcgctagatgttatacttgcaccatgaccttgttttgatatcaccgtattaatatcatcaccaatggtatcaaccaaaaaatgaacaggggctttcctctcaaagaattgatagcctaagccagctttacttgttttttgccaaagtggcactgatgtagttattgatggattattaattagcgcagttataagttcattatcatttttaacattgtatttaggatgttctgataaaaacgctctaaatccaatgacacgctggtaatcatgtacctcttttttgatacttttatcagtagcatattctctgggtttactggcatcccaagtcgcatttgtgatgtcattttgtatcagtatatttcttttggtgttatttttttttcgaaaagattgcctgagcctagaaaacacgttacctgaattagctgtagatttactcatacgtttaaagccgactttttctaaatctgataaagcagtagttctgggattatctaaaccatacaaaatatctccttctttaaattcatgtatgaggagttgtgtttctgtttcttgtggtggttcaggcgctagacctttatcatccttaaatgtgatagggttatttctcaccatccgatataaattcagcccgtctatagttcctgccggatcagcacttaaccatcttcccacccgcggctgataataacggaagccataataatacaatcccgtcgcatcccgctctttgccggaataacgaatcgttttgtaatgggcttcggtctcgtttcttgtcgcccatacggatgtaccgccataaggataatactcttcctcagtgataatttgccctgtgccatttaattcaagttggctgctgctaagaagattgtcatagctgtatcgcagttgattgttatcgatatcctccggtttaccgctctcccaatgcagaaccctcacttgcgcccgacctgcttcaccaacgctgataacctgcaaatcttcggtaatactattcccgtttttggtggtgcgtagttccaaacctgtcaggtaggtaactcgctgctgctcaccgattttcagcacccgtttgccgctgctgtcatagcgatactcttcaaggttgtcgctgctgcctgttttgttcacctgatgtaactctccccgtgaattccatttcaggctttgtcccggtatcagattcatttgatgaccgccggcatcaaactgtgcatcgacctgttccggtttttcggccaaatcttgggagacggcgtggttgttgcgattggaaacggtgatatttaaggtgtaattattattcgtcgctggtgaactgtggcggatttgcagcaggttgccggcattgtcataggaataattgcgggtgtagttggtataggtgctgctatcaataggtgaaacaggaggaggaagtttattgctttgctgcccgatattcgccatttcgcgccctgtggcattgataagctgatacagcgaatcataactgtagctgttctccggcacgactttctgattacgccagaagcgggtggcttcggtatcattgcggatattgagcacgttaccgaccggatcataatcgtaacgtaaatcttgcagcactttggcatcagacgggcggtgggtggtgatgctgattaaccgctgagtctctggttcgtaggtataatcggtgatcacgccattgccatgcacttcttgcagtttttgtccggcagcggagtaagtgagtgatttgagaatgatttgttcattctggtctttcaacgtcagccagcttcctttcagttgaccggcaatatcgtaatccaaacgctgtagattacctttggtatcagtctgagtgagaagggcgcttgtggcatctactgtgctctgggttgtgtgaagagtattgtccagtgcaccaagattgttatctgtccaattgactttctggtcatcaaggataaattgccgggattgcctgagcatggcacctgtcagtgaaccgctttgcagttgactcaatccggcgggatcataatgtttgacgcactgcccgacaaggttattgtctttggcttgctgattattgtcagaccagaacaagcgttccgtgatacggggtgaaacattgacggcctgctcgctgacactcaataaccgccccggcagggaaggtgcttcatactgccatttctgtgtgacctccgttgctgtgacagccattattgggcgcccttcaatatcattcaatgtgacggttcgtcctgcatcaacactgtctgtatgtaaaatctggccgtttaaatcatactgccagataaaattgggcttgatagtactgtcattctgctggctggcatgcagccgaggatcaatactctggctcaaataaccttgggtattatattggtggcgggtaatacgggtatcggttgcactgcccacttcggcacggtgataacccatatctctaacgtttaaaccccgattatcaagaacactcacgcccggggttttgttataaagtgcgggattaaaacggctcatttacgacctcctctaaatgtaatttgagagaactaccctagcatgatacagcgaataggcaggatgatatttattagattttgattaggtatatcaggcgaaaaaaatatacccttcatcttttaatttgaaatctattgggtatatatttgttgcatctgtacggaaaatataaattttaggttgcttaataacaatgattgatacagttgctttacagcgggcacttgataattggctgcttttctctccctgtctgggggttaatgtcactctgtctgattcccttggtaataattggcatagtgctagcgggtttgaacagtttgaaaataaaacggaaatgaaagcattacagcaatgttatatctatagcattaccaaaacatttacggcgatccgaatactgcaattagttgaacaagaaaaactggcattggattcacgattgacggaaatccttggtcattgtgggctcgatccggctatcacgatcagacagcttttgaatcataccgcgggagtccctaattacaccgagttcgatggatatgatgcggcaacgaaagcgagtccggggactccttggagctatgactatacgctggcgttgagtggtgaaaaaggcatgaaattctctccgggggaagggtgggattacagtaataccgggtacatgctattagttaaagtgattaaggtggtgacgggagaatcatttcaaaaaaatattaatgacggcatcatcttgccgttagaactgactaagacatatgtcgccagtgatattgatcgtggcaccgttattccgggttttagccgttggcttaataataatgatgtgatggaaaatataacgggaatatatcatcctcactggtgcaagacagagttgatggtttcaacgaccaaagagatatgtcaggtgtatcaagcactgtttcaagggaaaatcctcagccctgctttattagcggaaatgtgtaaacccatttcgattggcagaagtgctggccttttttatcgtaagccaagttatggaatggggttaatgatcgatcctgaatggggacacggagggttgttcggtcacggtggtgaagggccgggatttaacacatgggcactttatctgccggattatcaggggcgcgccctggcaatatgcattttttgcaataccagtatggcaggacagcctgtttatttagtgaaagattttttgcgcgtactcggcgcaccattcgctgaataacaaaatattccgatttcttttgaaggggtggcaaggaaaaatgagatttgtttttcctacggtgggtttataccgtttaaaataaccgaatttcaggttcagtatacagaaattgtgacccctatcacgctttataaccgataagagtaaaattaggaaaaattcctaattcaaccaagacagtagctcaagccaatctttctccacttttttaaactcccgggtaatgacaataccgacgaaaactctcgcttttctgcgatcttccttttttgcttcctcttgcatcaacaaaaaaggttttccttatcgtgattatctgaggatttcacatgtttaaaattctagatcaaattcgcaagccgacgctggatcttccggtcgaagagcgccgcaaaatgtggtttaagcccttcatacagtcctacttggtagtttttattggctatatggccatgtatctggtgcgtaaaaactttaacatcgcccaaaacgacatgatctccacttatggactgtcgatgacggagctgggcttgatcgggctggggttctctatcacttacggggtcggcaaaaccgtagtgtcttattatgccgatagcaaaaataccaaacaattccttccctttatgctgatcttgtctggccttgccatgatcggtttcagtatgagtatgggcagttccaacatcagcgttttcctgatggtggcgtgttatgccctcagtggctttttccaaagtattggcgggcctgccagctattccaccattactaaatggactccccgtaataaacgcggaacctaccttggcctctggaatatgtcacacaacgtaggaggggcaggggctgccggggtcgcactatttggtgctaattacctgtttgatggccatgtgatagggatgtttgtttttccttctattattgccctaattattggttttattggtttacgctacggcagtgattcgccagaaagctatggcttgggcaaagtcgaagaattatttgatgaagccgtcagcgaagaagatatcgcggcagaagaaaatcaaatgaccaaacgcgagatctttgttgaatacgtactgaaaaacaaagtgatttggttactctgcttcgccaatattttcctttatgtcgtacgcatcggtattgaccaatggtcaaccgtgtatgcgtatcaggaattgggtcattcaaaagaaaccgcgatttccggttttactttgtttgaagttggggcgctggtaggtacgttgatgtggggatacctgtcagacttagccaatggtcgtcgtgcgctggttgcctgtgtttctctgggcttaattattgtctgtcttgaattctaccaacatgccaccagtgagttcatgtatttgtcctctctgttcgtactcggtttcttggtatttggcccacaattgctgatcggcgtggctgctgttggttttgtaccgaaaaaagcgatcagtgtggccgatggggttaaggggacttttgcttacttaatcggtgatagctttgccaaacttggcttgggcatgattgctgatggcgttcccatctttggtttaaccggctggaaaggtacctttgttgcactggatgcttcggcatttatctgtatcggcttgcttgcttttgttgtcattgcggaagagaaaaaaatccgaaaagcaaaaaaaagcagtcgataaccctgaagaaatacattgacgccattgcctgaacgcagtggcgttttctgcttatcttttatctcaatgttcagtctattgcgaagcgacatcgataacggtagtttatgttgattcccacatccggtaataaataacaatgattaaagtagcattggtcgatgatcatgttgtggtacgttctggtttcgcccaattaatgagtttagaatccgatatcgaaatcgtcggcgaattcagttcatgtgctgaagccagacatgggctgccaggctcaggagcaacggtttgtattcttgatatttcgatgccagatgagagcggactttcattgctgcaagatctcccttccggtattcactgcattatgctcagtgttcatgattctgtcactatggtagaaaatgcattgaaagcgggggctcgtggttatctcagcaaacgctgtagtccggatgagctgcttcaggcagtgcgtacgacggcaaataatggctgttatctcacgccggatattgcgctgaaactggcgtcatcaaaaaatagtcagacttcattagatcacttgaccaagcgagagcgacaagtgggtgaaatgcttgccagaggcatggatgtcaaggttgtagcggccgagttgggattgagtcataagacagtgcatgttcatcgcgctaatgtgatgagtaaattgggggtaacaaataacgtgggtttagtgaattattttacgactagtgatctcgaccctgttcaccattttgtgtaaatgccatttcttagtaatgaccgtcaaggcggttaaattagcccagttagcccgccaactacgacttatctggggatagcggtgatctcaggtttcactgaacgcgtccaaggcttgaagcgctgcgtcttctgtcggaacctgataaatcgttttcagatcgcgtgtgaccgctttgttatctttcccggccacgaaccgcagattattacggagcatgtggacaatagacaactggatgcgcgtttctgaataaacggcatttattgcgtccgggaaacctttcagcccatcaacgcaagcgatgaggatatcattcagcccgcgatttttaagctctgtaagccgatcatttccccgaccgcgacagtgacattgttgtgcccggtattgatgccgtcgtcgccagtctgaccaatgtaaaatctgttcgattgtctttcccgctttttccatcagctttgacagcagcttgcgcagttccgctacattgagcggaatccggcctaccgatgttttttttctcctacccccgcaatatcaatcataacaataatgcagataatttatcgtattatcttaaactccagaacaaataaaatagaaaccccggaaaataagaaatcagaaataaataccacaacaatattaaactggaaaaaataatagattcatccggttttattctcaggaaatgtgatacaagcgatatcctgataaataatcaacattacaatgtgtggcttttctaacaagttgctatactgagaagctcacgtacaactgaaaaggcgttgattatgttaagtaatagagctgcaagacggttgttgggtatgcctcataaattgagtaattccaagcgtaaggtaataatttctcttcttaatctcacttccagtgatagtaaacatcaaatcccagaacaactgagacattcttcttttgtctgtatgaaaaaagatgcttattcaggaaaaataacctatcacccaggaaatacattttatcctgaacatttgaataccagtcgataaaattgcctgcttttattctaaaaaatttattgcggcagaattcattatcactaaaatgattatcgtgataaaaaagcgctaaaaacgaaccgcccactgatggggcggtttatagttattttatgaatcagtaatcaatcaaaaattgattatttgcgacgccatgtcgttccctgtgggccatcttccaactcaattctcatcgcgttcaactgatcacgcgcagcatctgccaacgcccactctttgtttgttcgggcatcgttacgctgcttgattaatgcttcgatttgggcaacgtcatcatccacatgagcccctccttgtaagaactgttcaggttcctgttccaacagccccagtatccccgccagtttacgcagttcagcagccaggccgttcgccgctgccagattttcagttttcaggcagttgatctcacgagctatgtcaaataatacagaataggcttccggtgtgttgaaatcatcgttcattgcttcagtgaaacgggcttcaaatgcttcgctacccgtaggctgagccgatttatccgtgccacgcaatgcagtgtacaggcgctcaagagcggtacgtgcctgtttcagattttcttccgtatagttcaactggctgcgatagtggccggacagcaggaagtagcgcacggtttcagcatcgtaatatcccagtacatctcggatggtaaagaagttgctcaatgacttggacatcttttctttatcgaccattaccatgccggaatgcatccagtaattcacgtaagggccaccatgagcacaggtagactgtgcaatttcattttcatgatgtggaaacatcagatcagaaccaccgccgtgaatatcaaaatgctgacccagttgtttgccgttcatggcagaacactcaatatgccagcccggacgaccaacaccccacggcgactcccagctaggctcacccggcttagacattttccacagcacaaaatccattgggttacgtttcacatcagcaatttcgactcgcgctcccgcctgtaactgctccagatcctgacgtgaaagcagaccataatcaggattagtatcaatggagaacatcacatcgccgttatccgcaacataagcgtgtccacggttgatcagctcttcagtgatctgaatgatttcagatatatgctgagtggcacgaggctccgagtctggacgctgaatattcagcgcatcaaaatcgctgtgcatctcggacaacatacgtgtggtaagtgcatcacaactttcattattttcagtggcacgtttgatgattttgtcatccacgtcagtgacattacggacataggttaaatcatagcccagatagcgcaggtaacgggcaatgacatcaaatgcaacaaaagttctaccgtggccgatatgacacaaatcataaatcgtgatgccacacacgtacatgcccacttttccttcatggatcggcttaaattcttctttttggcgactgagagtattgaaaatttttagcatcggtgggttttccgtaaaaagtgacgtacgtgtaataaaaacgaacgaatctgctgattatagacttctttatcagcgatataaataaactagaatatgaaaagccagatgagatatttcaccttgatatgaaacgctttgcaagcgccgcgagcgaccttgttcacagacgcttgcagagtactgactcaagatcacagatatgatataacagcggatgttccgaacaccctagaaaatagggtcaatcaaaactattattaggatttctattatggtgacttttcataccaactttggcgatgttgtgattaacactttcactgataaagcgcctgtaactgttgaaaacttcttgaattactgccgtgaaggtttctatgacaatacaattttccaccgtgttatcaatggcttcatgattcagggtggtggttttgaacccggtatgaagcagaaaacggttaaatcacctatccaaaacgaagccaataacggcctgaaaaacacccgtggcactctcgcaatggcacgtaccaatgatccacactctgcaactgcccagttcttcatcaatgttgttgataacgattttctgaatttccgttcagaacgtccagacggatggggttactgcgtatttgccgaagtggtagaaggtatggatgtggttgataaaatcaagggcgtttccactggccgcagcggtatgcaccaagatgtaccaaacgaagatgtgatcgttgaacgtgtcactatcagcgagtaattaatcgttacatgtgtacgctgtttattgcagatcttcatctcaatgagcaagaaccggcaattactgccggttttctgcgttttttgcgtgaagatgttatttatgccgagagtttatatatcctcggtgatttttttgattactggattggcgatgatgaccccaattccctgcacagtgaaattgcccaagcactcaacgagctgaaacaaaaaggtatttcctgctatttcattcatggtaatcgtgatttcctgcttggctcccgatttgccagagagagcggtctgatcctgttgccacaggaaaaggtgctggaattatacggtaagcgtattctgatcctgcatggcgacacgctgtgtacagatgatacaggttaccagcagtatcgtaagcgggtacacacgccgtggatacaacggctgtttttacttcttcctttgtttatccgactgaaaatcgcagccaaaatgcgtgcaggaagccaatacgccaacagccagaaatctgaatcgatcatggacgtcaatcaacaggcggtgattgagcattttgaaaagtatcaggttgattggatgatccacggccatactcaccgtcctgcaatacatgatattcaaatcacggataaaaccgtacatcgcggtgttctgggcgcatggcatcatcaaggttcaatgttcaaagtgacgaaaacgtcgattgaactgatgtttttccccttctgatccctgttgagaatttctgtaaaaatcgataaatcaaacaacgcaaacgttttccttgtaccattctcatgatatgatccgcctcctcatatatattcgttctgctggacacccaatacaggagcatctgagttatgacggcccgccctgatcccgcaaccgctatttctgcaacttcaatgcaacaccacgccaaaatcgccattgtcatgggttcaaaaagtgactgggcgacaatgcaacatgccgctgatattttgacgtcactcgatattccctttcacgttgagatcgtttcggcacaccgaactccggataaactttttcattttgccgagaaagccaaagaaaacggttatgacgtgattatcgcaggtgcaggcggggcagcgcatctgccaggtatgctggcagccaaaacattggttccggtctttggtgtccctgtgcaaagtgctgcactcagcggagtcgatagtctctactccatcgtacagatgccaaaaggcatccccgttggtacgctggctatcggaaaagccggggcagcaaatgcggcgttactggcagcgcaagtgctggcattacatgatggtatgctgtttcagcgtttgtcagactggcgttcagcacaaacacaagatgttttgaataatcctgatccacgggaggacgcatgaaaccagtctgcgtattgggtaatggtcagttgggtcggatgctccgtcaggcaggcgagccattggggatcgctgtctatccgattgggctggatgccgagcctgaatcagtaccataccaaagcagcgtcatcaccgcagaaattgaacgctggcccgaaaccgcattaacccgcgaactcgcccatcataaggctttcatcaaccgtgatatttttcctctgttggcggatcgcctgccacaaaaacagctcatggatagtttgggtttggcaacggcaccgtggcgattactttccgaccccagccaatggccgcaactgtttgcggagttaggtgattttgttatcgtcaagcgccgtaccggcggctacgatggacgtggtcaatggcgcattcgaccgggtgatgaagcggaattacctgccgaaatttacggtgaatgtattgtggaacaaggcattccgttttcaggcgaagtttcactggttggtgcccgcaatgtgcaaggccaatccgtgttttatacactgacccataatctgcatcaggaaggtattctacgcaccagcgttgccttaccaaatgcgggtaatcagttgcagcaacaggcagagaagatgctgtctgccctcatggatcacctgaattatgtcggtgtcatggcgatggaatgttttattgttggcgataacttattaatcaacgaactggcgccccgggtacacaatagcggtcactggacacaaaatggcgcttccatcagccaatttgaactgcatcttcgtgcaatccttgatctcccgatgcctcagccagaaataatggcgctatcggtgatggttaatctgatcggtacggaactcaatccagaatggctcggtttgcctctggtacatttgcattggtatgaaaaggaagtccgcccagtgcgcaaagttgggcacctaaacctgactcacgcagacaaacacgcattgcaaacaacgttacaggcgttgatccttctactacctgcggagtaccaaagcggtttggaatgggcaaaaattaaattgaattgatgagtggtatttgactttatgaattcaaggaagtggtaatatttgaaaataacttaccacttcctattctagctccagcaattatttttatttcttcaataacgttctggatagtgtatctacagtggttcttgtcatttggtcgatttcattattgaggagatcacccgctttgatcttgttgaaattggtcattcttaatgtttctggaatcaggttcaaggctacggttttattctcttcatcaatgccattaatagttaaactacaaccatcaagaccaataaaacctttcaggaagaaatacttaatatagttgataaatatcgttaaccgcattttcttgttcagccttggaaaattgctgatatatgacagaaccacttcctaagtacaaattcctgaaatcatcagggctcgaaaaatcaatagcttcttcaattctatagcttttaagtatttgaaaaaaacaatatcttgcgagtcagtcttgccaaatgctgccgcaaaagatggggagaagtggcgtgttcttcgcctgctggacggtaacggagaaacgatatctttattccaattttattgtgaaagagactacactttttaatattgattggtttttactcattaatggaattggactaacacggcaaaaaacaaacaacctgatgggagagaccttatgaaagcacttgtttatcatggcacaggcaaaaagcagtgggaaacaaaatcccctcctcaacttattgagtcaaccgatgcaatcgtccgcattatcaaaaccaccatttgcggaacagatctacatatcctcaaaggggatgttccaactgtggatgcagggcgaacattgggtcatgaagggattgggatagtcgaatccgttggagaatctgtccgtaatatcaaagtgggtgataaagtaattatttcctgcatcaccgtttgtggtcgttgtcgttattgtaaacgccagctttattcccattgtgaagatggcggttggatacttggacataagatcgatggcacgcagagtgaaaaagtgcgtattccccatgcagataacagcctacatcgtctgccggaaggcattgatgaagaggcggcattaatgctcagtgacatcctgcctacgggtcttgagattggtgtcatcaatggcaaggttcaaccgggcaataccatcgccttgatcggcgcaggccctgtagggctttctgcgttactggcatcccagttctattcacccgcccatatcatcatgattgataccgatgataaccgccttcatgttgcacaacagtttggtgctgacacagtcatcaaccccacacatcaaaatgtggtggaagtcatccaaaagctgactgatgggattggtgtcgatgtcgcaattgagtgcgttggtatccctgcaacattcaagatctgccaagatatcattactgctggtggatatatcgctaacgttggtgttcatggaaaatcagttgaattgcacttagaagatctttggatcaagaacatcactatcacgacaggattagtgaacacaagcagcacaccgatgctgttgaaaagcctccaatccggcaaaatttcacccgaaaagctggtcactcatcgctattcgctaagtgaaattaaaaccgcctatgaagtttttggtaacgctgagaaggaaaaagcactgaaaattgttcttaccgcagagtaaataaagggatgataaggtataacgcaatttggacataaaagttgtattcataagtaaaacgatcaccgacatcaaattcaaagtcatcaggcgtgattttgtaaggattatacggaaaggcaatcccgccagaataggagattccgtaatttttgccataaatatggaattgatgaaggtgatcatccggttctgttgcattaagggaagaacaggtcatatgcgatcttttacagaatgagttgcccgtgtctttaattcaaaaaccttcaagcggttacattatcctatcgggatcactgctcagtgtattcgcgggtacctcgcttatactttgagcctgggcaatctcgaagagatgatggcagagcaaatacctcaataatcttattgagcaagatcatcggaacattaaacgtcggatatggccgatgttaggctttattaaaaaaggcgagtgccttctttgcgaaagaactgctgtaagatgtgggttcattaaagaacaggcagagccatttcccattcaccaattatgtcgatttatgcctggcaggcaaaatccattcggttactttctgatgaacaacgagaatgacaccgaaaggcaaccgcgctatttaaagacccctgagggttggtcatatctggcgatagtgatggatttgtattctcgccggctagtgggatgggatatgtcaacggagacagatacgacactgattagtcaggcgttgatgaaagcgtatcactgacgccagccgttaaaaggttgtgtttttcatagtgatagaaggagccaatacaccagccaacaatacagggatctactcagcagttatgacatgagagcgagccagggggatgcagggcctgttgtttaaactctcgctgttactgttgttgatttgatgtgcctgcttttcaccatatcaggcgaggtggttctgctactccccagcaacaaaatcgattagaataaatttcctactataatgagaagaaattttaatatatggatagaaataaatggaaaaaggttgttggttggtttcgtgaaaagatccagaataatttctgggcaaaatggggctacattccgataattatgttttatcctaattcactcaaattctggttccgtgaatatgccccggaatttttgccgaactttgtaactgatattattttctcaatccctattgtttttgctgtaatttatatcccactgttattaattgattatctggaaaaaacaagaaagtgaatctcacctcgtggtaactccgcctgatcccagtatccgattgccagctctctgcttggttgagtaaagagctatgtcactcatgcagcaagatctgccgttgtcgtccttgatatctttcttcaatccaatcatcagttgcgtcagtacgtcaatttcgtctactgatttaatgattgagtcccagatttcctcggtcgttctgggagcagcagcccgagcttccatctcaacttataacgttgtcgtgagttcatatgtcctccgcaaataattgtcactccgtttactgatcccctgcgaggtcgacttaccacaccttcggcttcaatctgctgagccaacagggaagacatgtcatttttcatccgtgaaggcacatcatcacccagtacacgatcgatggcttgacgtaccagaataccgttagccgggatatcgccgtatttttccttgcagaccgccgggtttgcggcacagaccgcaatcagctcttgctgctgtttgaggctcagatcttccatttctttcacgatttgcttgcagtcgccacgcgcctcacactctttggctttcgctgcaaagtcatcgatttgcttcgcagtcaaaaagttattctcaacagcatcccagttggcatttaaagggtaactggctggaagcagccgggtttaccactgggcaaccgatgcaagtctgcattgagcatgggcagttgattatccggctggttgaggacaactgacggttaaaaggaagatcccagctcttgtgggctgggatcttgatgttaacagggcagttgatctagtaagatacttagcttgtctttatcttccgggtgtagttgaagatacttttcacaggctaatctgacgtaatggtaacaagtttcttcagtcacaatgaccctctcttcttctgttggaggatacccaatagcaaattcaacaccttcaaaatgctcagtttcatcataactgtccatgtccggaaaattacaataagccccatcaacacttaatgtccatttttttgatagtagctctatagcatctaaaaatttaccatcctcatacattcgttcaaaatatgacacgataattaaatctaagcctaaacccatatcaaactgactaaataattcttttttcatatcaaatctcaattaggatgaaaattttttactcttcctgttgttttatcgacatatattctgaaactaaccccatcaacaacagcagtagcttgcccattactactagccatagcatctttataaccttttgtagaagcttgctgacccaattctaaaattttttgatcagtaaaaactttagggtcataaacagtttttgtttgaattgctggcttatattccccagtaagatttcctgctcgatcttttgtgggtacttgatatttgatttctgtaattcctggtactttagtgggagcctcactcaatatcttcacattatattgagttaccgcactataaaagtaagcgactcatttgaaccgtattgacgattagatgttggtaaggctgaatttccagggaagcagctcgtgtaccttgtttgatggccagtcagctatatggctgatggtgtaccgcaaccacgcctccggttctacaccattaagacgacaggagccgattaatgagtacaggatggccgcccgctcaccccggatgcgcaatattccggagggaagcgccagttcacaacagggctccttggctgcgggttgctgcatggcggggaccggctgctcaacaggcacagtgatttcagccagcgtaaccggcaggagccatgaactgtcattccgggagctcagaagtccgcgtttataaaggttacgccagttaaacaacaggttgtcgttgatgccatgttcacgcgccagttgtgctacattggcgccaggttgcagtgatttttcagccagagagattttaaacgcgagcggaaaattcgggcggcgtgaccgcttgcgtacaacgggctcacccgctaaaaccggctcagggatatccgtcatgacgggattggtacgcgcggggtaaagttgcgattcgagcttatcggaggtcatattatcaggcaacggccagctaattccctgccttctgaagcgaacaaagagatggtcggccacctttccgctatatcaggggtaaattgcggcttgagttgaaacacataacgttcttcccggcgaccatgcgcttcttgtttaatttcagtgataattttttcttttcctgcatcaaacacacactgaaactgaaactgagactgaacggcatcccacagacggggctggtttttcttcacctgaacaacgacgtgggctttcttttcactgattttttgcagggtttcacgctgacaatgcagggcatcaagtgtcacaatactgcctttcagattgaggatatccaacatttgacggacgacactgatttcaccattttttgtggccgtggctttctggctcagcactaatccccgttcggtatcatacgcggtgaccagctggacagcgtttttcttttcattccggtaagcccgtcgcaggacttttccgtcaaaggcgataaccgatttaccatcctgctcacgctgttcattaacccagttcagtaaagcttccagtaaagaatccagctcgatagcttgcagtattcttgcaatggtatgtcgacggggtatcccatggagaaaggtacggtattctctcagccacttaattttggctcggccataagtctcaatgtcttgccagccctcggcaccagccataatggcactgacaacgaggaaaataacatcaaccagatcatactgacggttgatatcagagcgggtttctttcacaacggataaatgttcaatcagggtcatagggggcgtgtattcaacctgttgattggccatcaataatagaactcacgttcgatgaatgtgccaatgatcttgtcatgcatttcaactgacttagaataacccagcgtcttgcgattgagtcgctttagcctgttacgcaggttcagattttctcgttcaatacgttgagtataaagtttaccggtgatatgtttctcatcagccaatatgtcatatgccccgaaattatcggtgcaccagaatgccacatcaaaagcggataacttttccagcaacgtcctgagtgtctgtttgctacgagcgccaaaagcgtgagcgacaatacgtttcaagcgaggctcccacgcgtaccacagccagcgttgccgttttttgttactgatgaatgaccccatttcatcgacttcacagataagctgaagctcaggggtatccagcggcagcgtggttacacatcgcagcgcgagttttttaaagtgcgtacaacagcgttaatgctgacatgaagtgcccgtgccgtatcacgaataccggcgttattcatggcaagctcgacgatttgctctttcatacccgaatggcaagcccggtaagtgtattcgagctggaaggttctacgacaggactggcaataatatcgttgatgcccaccttctcctttaccgtgttttttaacaggcgtggtttggccacaaaaccgacacttcacttcaactaatgccatcactatccctcacgtatttaccctcattatacgtgagaaacaacgggatgaatacgtgaccaaattatgaagccatgcttcatttggcttgtagtttaattgtctagaatataatcctattgggataggatcttaattattcttataaaattttcaccacttcaattcgctgtagaacagaatatatctttagatacggataattaattttcgacataaaatttataataaaataatttatagtcgttaaaattaaaaaccatataattaccaaatcattataacttagatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatagtcatctatgaaaacagatggctatatctgtttgtaataatataaatatgtcactaccagctatttggttcagccactggccagtgatcgcagtctcttttctcttgcacatggtgcggggcggaaatggatgcgtggtgagtgtaaagcacgtttaaccgggcgttacaatgcagaacagctctctcgtacagcatttggcagtcgtgtgatttgcctggataaacaactgatttttcaggaagctccagaggcttataaacctataggcggcgtgatggatgctatgctgcaatcggggctggtgaaattgatagcgcggcttaagccggttctgacatataaaacgcggggtaacaaggaatgatattgttgcagatttccgctgctcaggggccagatgaatgtgcgctggccgtcagaaaggctttggaacggttgatcgatgaagccgacgaattaggtattatggtcaatatattggagaaagagtcagggaggcgttctcgtacattacgttctgtgatggttgctattcagggcgaaaatgaacagcagttttttgagcgctgggacggaaccatcaaatggatttgtgcaagcccgtggcgaaaaggagacggccgtaaaaactggtttattggtgtggcgcagtttaagcctttacagcaaataatggaaagtgaaatacgttttgaaacattgagagcctcaggtcctggtgggcaacatgtcaacaaaacagaatcagcaattcgggcagtgcatattgctagtggaattagtgtcaaggtacagtcagagcgcagccaacatgctaatcggcggcttgcctgtttgttattggagcatcggctacagcagcaacaggatatgcatcaggcccaacttaaggctgaacgacgtttgtttcacaatcaaatagaaaggggtaatcctgtacgtacctttgcaggtatgcagtttagtccgcaaatttgatgataaatagagcgacgaagggtgtccgtcgctctagacgcgattattgagtactttgagataaggtatcttttatttgagccttgcaggtcttgacggacttatctaatgattcgtcaaaatgtttatggctcggaaatacctgtttattctttctgacttctatgactgtttgtttgacagaggaaatcagttcatccttgttgctatggatttccttaagatcgaatcccttcttgttcaactcattaaaggttttttgagctatagcatctggtgaagcattagttttgaatgcttctacagaggcttttccaaataaatcacaataggtttccgctgttttatctgcattcatatgtgcggcataagagaagaatgggacaaggaaaagtggtagtaaaagacgtttcatagtttcctcttatcgactagaccggggtagtggtgacaacattaacaatagtacattattcatggcttgccccgaattccggtggaaaactgggtgccttggttatgtgattaatggtgtagctgacctgtgcactggccttttttacacaggatgcggagtaactgaattgggtcatgtttactatctgtattgattcgggcgaggaatctgacatttttatctgttatcttgagtgcatcaacttcaagataattcccagagcctgccgtaagtttgtacacaatcaactctttgacgccatcaccgttaatatctgcaaatgtcactcttggcttattgttatcttcgaacaccgaaccatcacgggaaaaaacagctccggtttcgaattccgtcagatcccgatctttgaaaacagcgatagagtagctgccgattgatctactttccagatcgctaacggatatgacggcaaatctcttatcaggtaaattaatcaatgctgcgtcttttgcgagagccggggttgatagtgatagaacgagtagagcagggataacagcaatttttagtattttacacaaatacataagcaatactccattggctattgtttgtttcaacgtgtgggtggtattaaatttatatcgtagcatggatttcaaaagctgagatgcttactggccggatgaagttgtcaattgggttaggttgatagcctataagtaagaaaatgtgatttcagtgcggattattagtaaattttattattattttaatattaaaagtgtggttattgactataaataacaagaaaatatttcgtaatatggttttttttgatatggatgctgaattttattctaattgagatatatcattcttgagaaatatccaacaattcgttacacattggttattttttgtttgaaagtatgaatgaaattaattgaaagccaaaaaatcaacgggagtggaaactcccgctttattaatctcaacatatatcaaactctacgtgctgtttttttcaattttttctacaaccttgttgtattctttccaaacaacggatactggtgaacttaaacaacagatagagatcgaaccgcctgttgctgggtgatactcgtattttgattttcctctataaacccgtttaggcaaaatgttgtctgcggggttttttctttttcgctctaacatcaattataacctcactagcagattatctgatggccagatagtggaacattaacatcttattaacttatcgttgttgtttctactgtaaaaataacaattgaaaattttaatatgccatgatggttttttccaactatcacagtattaaaatttaataatctcatttgaagaagaatattactatatgttttcgtaaatctgagaaatttcaatattaaattttgtaattattttattatttttaataaatagagttattgctacataaggtacatgacagtatatggaagggaggcaaagtgagtgatacatttggtattcttgtagtaagggaacttctgattaaagcacgttttttataagtgtattgtattgagattgctttgtggtggttgtattctgattgccaaatggttgtttattatgggtgaaaatgttaattaaattgtatttttgcaatatatccggaaacaagattacgtagcatatattactggtaaaatgcgcttgagaggcttgaaatgggcaataaatatccagtgaaacttagtgtaaatcttaataaatgctaaagtaaatgtaaaaaaattattaaaagttacccattgaaatagatattgtgttacattcttttcgttttactggtaggtatctctgtatttttgtatacagaattgtgttgcttgtgactggttaattataaaggatattgagcacaataaattttgcaggatactgatttatggtcagctaatgtttgctaatagtaaggggaaaatatcttgacggatctgattaacttcattaacaacatgctttgggactacgtattattatatttactccttggagttggcctttacttcacactgcgcactggtcttatacagcttcgtcattttggccacatgttttcagtcttgaaaaatagtaataagtcagatgattctggcatttcatcttttcaggctttatgtactagccttgcagcacgtgttggaacgggtaatctggcgggagttgcaattgcgattacggctggtgggcctggcgctattttttggatgtgggtagtcgcctttattggtatggcaacttcttttgtggaaagcacacttgcccagttgtacaagacgaaggacgatcaagggaattatcgtggcggccctgcctactatatggagaaagggttgaagaagcgatggatgggggtattgttttcagtcttccttattatcgcgtttggtcttgtatttaattctgttcaggcaaactcaattgcggaagcagctgcttttgcctttcatgtcaaacctatttatgtcggtattgtattagtcattatcagtggcgcgattattttcggcgggttgcgttcgattgcacgggttgcggaattaattgtaccatttatggctggtgcttatttgttactggcgttttgggttattggtcacaatattgagcgtattccagaagtatttgcattaattatcaaaagtgcctttggtcttcaggaagcgattgcgggaacattgggttatggcatttctcaggcgatgattcagggtgttcaaagggggctattctcgaatgaagcggggatgggttctgcaccaaacgcggcggcttccgcatctccatatccgccacatccagcctctcagggctatgtgcagatgctgggggtatttatggatacgattgttatctgtagtgcaaccgctgtcattatcctgtcttctggtattctcaatgaaaatgtgactgctatcagtggaattgaattgactcagcgggcattatcatcggctgttgggcattggggaacgacattcattgccattgcaattttctgttttgcttttacatcgattattgccaactatgcttatgctgaaagtaacatgatattcctggagcgtaaccacaccgcaggtttgtttatcctacgcttggctacgttaggcatggtgatgtttggttcgttggcagaagtgccattagtctggaatatggcgaacttatcgatggcatgtatggcgattgttaacttgattgctattcttttgctatcaggtattgcgataaagctggctaaggactacaaccagcagagaaaagcagggcagttgccgacattcgatatcaatatgtatccagaacttcagaaggaagttgaagaaggcatctgggataataagctatctcaggacagccaaaagtgtagtcattgatactgagttttatgcttaataaattgcatgttgcagcgcggtggtaaatgagcgaagcgaatccccaggaatatagctagctatatttctggggtgagtgaaagccacaaataaagcaacaatttgaaaggtgagtgtatacattcattatgagtaacatatagtcatgatgattctatttttcctccataatcactcatcaaaaatgataagaagattaagattaggtgcatgtattacgttgttgattggttgtagtcatcagcctcaacgggaagtcagaaatgattatatcgttgatcactcgtattcttattcgactaagcaaggtatcgattcagcccgatttcttgttttgcattatacggcattgaatgatcaaaattctttacagatattgaccggaggtaatgtcagtgcccattatctcatcccatcgcggccagaatatgagaataaagaacccgttatttttcagttggtttctgaaaatgaaaaggcctggcatgcagggacgagtggctggaggggatataagagtttaaatagtaattctattgggattgaaatcgttaattgtggttttaagcagcactttatcaaaaaagaatggtgcttataccacccatcacaaattgatgcattaatccgattggtaaaagatattattcagaggtatcaaattgaggctgtgaatgttgttggccatagtgatatcgcgccactcaggaaaaaagaccctggtcctgtttttccgtggcaagcactttatcaacaaggtattggtgcttggccggatctcataacggttaataaatatctggccaacagggtgccgagtatgcctgttcccgtcattggtatacagaaagcgttggctctttatggctactccatacctcagacaggtcatttggatgaagatactcataaaatcattcaggcgtttcagatgcacttccgtccatcagatatcagtggtgttcctgatgcggaaacggaagcgattgttttggcattagtcgaaaaatataaatgatgattaatatagcacgatagtgctgtgctattcagaacactggaataggtatcatgacgtgagggaaggaaactgcggccttaacgaatggccgctgatggtgctagagttcataactggcaattataagtcaaatgcaatggaagcttaacctcaagttctatatctgtactttgacgaaaatcgtaaggtgtaatgccatattctttacggaacatataggtgaaatgagattgagagccgaagccgaaatctaaggcaatatcaaaaatagacaaggagctgtttctcagcaggtgaacagcgccggccaaccgccgttggcgtatgtacttcccaagcgaaatttccgtgacttccttgaatattttctgcatgtgccaaagcgaatagccagaataagcagcaagctcttcaagatggataactcgtccaaggtggttttcgatccatttactcagtgcgcatacaagtgctaagtggttatcttgtggcattacaattttaaattgattgaaggtttaaggagtatacacaacttcctttcaagatgacaaaacccatcagcataggtattttcagtaatcaaacgtgaaatttaatttttccacataaaaactctctataatattttattataaagctaactacaatgaaattattgtaaggtgactcaattgaacataaaaaaaacttttttagtgctatgtttaataacagtgtgtctgtttttatatttattagcattggatatccattgtgatcaaggtaatgaagggtttgagttggggatctgttcaattactcgatacctgcctttttgatattcacctcaatcatcctcttgcaactatctgtgctaacatacgtttgcagtattcattcttgggaaatgatgttttaatattcatctgattctaattagcggactaagagcttatcccagcaggcgttaattgttgacggcagttcgaacacggactgtgtgtagaaaccggagtataaacgtagtttcttaaggggtagcacgtgaagatgattcgcggagcttcccctttgggttgtactaaaacgcgtttaaaaactattgctttcgtatgaacacagtctaggttcaaagtgataaataagatagcttaatggggttagtttaaatgttgcgctaaaatcagagcttaacccaatagctacaattgttaaggtagtttgagcacgacaaatcgcgcagaaattaggggaaatgagagaatttctcgccctgttcaggttcaaaacgacaaataaaatagcttaatgagacgggttctaagcattataattaagaggactagatggtagaacaagcagaacaatctacgcttaagcgtggtttaaagaacaggcatattcagcttattgccctcggtggtgcagtaggaacgggattgtttttggggattgctcaaaccataaaaatggctgggccttcggtacttctcggatatgccattggtggttttattgcatttctaattatgcgccaactgggtgaaatggttgtcgaagagcctgtcgctggctcgtttagccattttgcttataaatactggggtaattttgccggttttctgtctggctggaattactgggcaatgttcattcttgtcggaatggcagaattgacggcagtcggcatgtatattcattattggtggccggaaatcccaacatggatttccgctgcaatattctttgtgctgattaatgccattaacctgattaatgtccggttatatggtgaaacggaattctggttttctatcatcaaagttactgccattattggcatgattatctttggggcttatttgctcatcagcggcactggcgggccacaggctagtgtaaccaatttatggcagtatggcgggtttatgccaaacggggtttccggtctgattatggcgatggctgtgatcatgttttcatttggtgggctggaaatggtcgggattactgcggcagaagctgaagatcctgaaaaaaatattccaaaggcaactaatcaggtcgtttatcgaatcctgctgttttatattggttcattgtctattctgctttcgctttacccatggatgaatgtggtcgaaggcggcagcccatttgttttgattttcgatcacttggataacttttgggtgtctaatatcctgaatgtggttgtattaacggcggcattatctgtttataacagtggcgtgtactgtaacagccggatgctgtatggtttggcaaaacagggtaatgctcctcgcatcctgacaaaagttaatcagcgcagtgtacctgttttatcaataggattgtcagcattggcaacatctataggggtgctggttaactatattatgcccggaaaagcatttgaactgttgatggcgttggtagtgacaacgttggtcattaactggatcatgatctgtctggcacatctgaaattccgaactgcaaaaaatgcagaaggaattaagacgaagtttcaggcattttggtatccattcggtaactatttgtgcttaatattccttgcattcattctcgtcattattctgatgacaccggaaatacgtatctcagttatcctgatgccgttctggattggcatgttatggggaggctacttgttttccaaggctaaaaaggcaaaggtgcgagttatctaacggtaaatttgttcagtattcttccagccggatctatttccggctggtcttatgattagttttattaaacttcctatagccagtatcatattcagcagggaaatgatacaggaagtagaatttgcgtaacataatgtgtaccactcagtctaacttctccgttcagttatcttgtatcaccattgccagcgtagccagccaaaaagcatattcctgctattgtaggtcccggaaatataagttgactaaaatgacagcctgttatattcgataaaaaatcggtaatggcaagaggagggggatataataattattatttgctgtgacatttaatgtcaatcccaatcccattctgattctgattctgaaactatccaaagtgcctgatatccacacgctgtaagctttatgaaataaaatattgctctaatagaatagtggatgaatatggctccatattaggattgaataatatttaataaaggataaataaaatataacttagttatgtttaaaataattatattgtatataccagccttgaaatgaagttagtcataatttttattgttatctgaaatattttttggaaattataaatctctggtgtgcttcataataggtgtgaaaaacagcataaagtattagattatttaaattggtttcctggggttaaaattttatttttacataaattcatattgttgtgttatttatggactttttagtaatttaaaaacaggaacagttgttaagggttttaaatgtgtgcgttgggttcagcccctgaaaaaaatggcttgcgattatataaagagtatgtgataaaacacatgggtaaacgaagtattggttctgttaatgaataacagcgacgaatatgggtttgtttatttttatgtcaatcggcgaataaagcgattcaaaggaaatttttgaaatggcaaaaatcactggtattgtgaagtggttcaacgagtctaaaggttttggttttattactccagctgatggtagcaaagatgtatttgtacatttttctgcaattatgaacgatgggtttaaaacattgtctgaaggccaacaagttgagttcgaaattcagaatggtcctaaaggtcctgcggctgcaaacgtcacagctttatagtaacaaacttattttggctggtatttgattactgaccaaatatatttatcattagtttggcttcttgacgataactgattgcaaaaatcactctattgcgttactaatagagtgattttttattttgactcggggcgttcttgattgagctgagaagtacccgtattacctgatctggataatgccagcgtagggaagtcatggtatctcctattctgatactggcttttctttggctggtgctaggagtcaccatcatgagaattaattcattgaccatcgcaggaaccgatcctagcggtggtgccggcattcaggctgatttaaaaactttctccgcacttggagcctatggcacaacagtaataaccgctctggttgctcaaaatacaatgggagtccaatcagtttatgacattgatccccgctttgtcgctgagcagcttgaatcggtgctttctgatgtcagaatggatagcatcaagataggtatgttatccaatgttgctaatgtcaatgtagttgcagaagctctgaatcgttaccctgttccccatatcgtgttggatacggttatggtggctaagagtggtgatcccttattatccccagaagcaataactacgatggtagagcaactcttgccaaacgtctcactaattacgccaaatttgccagaagcggcggccatactgaaatgtaacattgccgaaacggaaggtgaaatgttgcagcaggggcgtgaactgttttcaatgggatgtcaggcggttttactgaaggggggacatctggttaatgaagaaagtccagattggctgtttactgttgaaggagagtggcgttttactgctcccagaatcaatacgcgacatactcatggcacaggttgtacgctctccgcagcgcttgcagcattacgtccccgttatcctgattggaaaaacacactgccagcggcgaaaacttatttgcagaatgcactggcgcaggcggatacactggatgttggaaagggaatagggccagtgcaccattttcatcaatggtggtagtagtggcatcatagccatatggtgattaaataatgggaataactatatccccatcatgaaaaatggcgagttgaagaagtgcggttaggcaatggttactgtcttgttgaggtaaacatcctgaaccgagtggattaattctactccttctttcattgattttttgaacgccttacggccaagaatcagccccataccaccgctcgtttgttgatgaaggcagtgcggacagagtcgctcaggatgcaccgccagagttgatcaatcccgcacgtcccatataacagttagcaagctgataacgaaccagttagaacagtacttattaaaacttaactatcttgcagggtagttaagttaaataatcatcatttggtttggcatgatgaaaattaaacataagtattgttcttcaatctaataatttgaaaagagttttcctaaaatttccttcactaaactgaaggattattaatgatatttatcataagatgatttttttatttataataaatagagttattaattatttgttagggtatttgtaatgaagaaacagaaagtattaattaaaacaacatatttttattatgggattaattttaactatttgaatttattgaattttatttatttccgaataaaaagaaaaggccagctcaagggagattgagccagccaaggaggtggttcctagtcttacagtaaaacttttttagttcttcatttttcaagctcgataatacgagaaataaaatagcattgatgtgatctatttctaaaaaaacagaacaatttctttaaaaatttattttcggttatttttcttgtatttcctttggttgtggtgttctggtattggttccctttaaatttcggataagcagcgtatagttcaaaataatttcttcaggaatgggcagatagacgatatgaccatctccgggtgctacttcaattgcctggccttttttatttgccatagattccagcgtaaagttgatattacctgatggtgtcatcagttccagttgatctccgaccagaaatttattttttacggtaacttcagccagaccatttacacgattgccagtgaattcgccgacaaattgctgggtatctgacattgaatagccgtattcataagtctggtacgcgtcatgagtatggcgccgcaggaacccttctgtgtaaccacggtgtgccagaccttccagtgtggtcatcagagtggagtcaaaaggcttgccagcagcggcatcatcaatagcacggcgatacatttgtgcagtacgggcacaataatagaaggatttagtgcgtccttcgattttcagtgaatgaacccctatactggccaatttttcgacatgctcaatcgcacgaagatctttcgaattcatgatataagtgccatgctcatcttcaaaagcactcatatattcgcctgggcgtttagcttcttcaatcatgaaaactttgtctgtcggcgttccctgcccaagtgtcggctccatttttttgaccggaataggatcatgcatatgaacgatattaccgacattatcttccttgccttcctgcacattgtattcccagcggcaggcattggtgcatgtaccctgatttggatcacgtttgttgatatagcctgataacagacagcgaccagaataagccatacaaagtgcaccatgaacaaaaacttcaagctccatatcaggaacttgctgacgaatttcagtaatttcttccagcgaaagctcacgggagagaataacgcgtgtcagtcccatctgtttccagaacttaaccgtggcccagttaacggcattggcctgaactgaaagatggatatctatctcaggaaatgcttcacgtaccatcataattaagccaggatcggacataatcaacgcatcaggctccatttcaacgacaggtttcaaatcgcggatgaacgttttcagctttgcattgtggggagcaatattgacgaccacataaaaacgtttgcctaactcgtgcgcttccttaatcccctgagccagagtttcatgattaaattcgttattgcggacacgcagactataacggggctgcccggcatagatagcatctgcaccataagcaaacgcatagcgcatgtttttcaaggagccggcaggagacagtaattctggagtaaacatcattaataacgttctcgatctgagttcaaatcaggccttgtcattaaaagcaaggctacgggaacaagaattttaacgtttaatctatctatggcacaaatttattgtgggaatagatttgtgcttacagtcgatggaaaaggaaaaaacttggcttttgtgattatcgccggaagggttatgaaaagtcacttcggtttggaaataattaacagtggtattttgggtatcttttcgggagccgacagatgaggttgactatcacggttccagttggatgaattttcattggagtcatatcaaagagtgggtattacgcttgtgatagtgtgttaaagcggcatcacgctttcaatatagtgagtgtgatgatgaacatttataccaaacggcatatctccgcttcccaacgatagcctaacccatagatggaacgaatgaaggacttatcctcatctaattgttccagttttctgcgtaagttcttgatatggctgtcgatagtacgatcattaacaatgcggtgatcatcatagaggttatttaacaattgatcgcgggagaatactcgccccggctggctggacatgatcttcagtaagcgaaattcaacaggcgtcagctcaagaacgcgatcaagatagcgtgcttgaaaatgattttcatcaattgtcagggagccatgttcgctgatgatatcttgtggacgatagcaacggcgcaaaatggttttcactctggcaaccatttcccttgggctataaggcttgcagatataatcatcggcaccgatttccaaccctagtagccggtcaatttcttctgttctggcggtcatcatcacaatgggaacatcagaaaaccggcgaatttcgcgacaaatcgatatcccatcaaggccgggtagcatgatatcaagcaggataatatcaggttggcgtttctgaacatgggcaataacttcatcaccacgtatcagccattgtgtctgataatctgcggcttgcagataatcaatgagcagttgccctaattttggctcgtcttcaacgattaaaatggtgtattgtatagaatgtgtactcattgtgctttatattcaggcagttcaaccagcggtaattctacgtgaattttaagaccgcctaaaggtgatctttcagcataaataatgccatcgtgtgcttcgacgatattgtaacagatagccagccccaaacctgaaccaccactggcgcgattacgggaagactcacagcggtaaaaacgtttaaaaatctgttggcactgttcgacagtcagtccgggtgcgctatcctgccaatccaggatccacttttggggagtgagatgtgtccgaatgatgatgtttccgggagcagcggtatagcgcaggctattttccagcaagttttggaataactgtgttagccgacctgggtctgcgaacaaaattgcgttttccgtcaagttcagttccagtgtgatctgcttgtcagcaaaacgtccacgataagaggctaaggtgatttgcagcagatcgttggcattggtcagttcctgtcggtaggctaacgaaccacgatcacaaagggataataagtgcaaatcatccaccagctttgtcagtgtggtgatttccgtcagtaatgagtggattgtctctggcgttgattggcgaacgccatcctgcaaagcttccagttcaccacgcagcacagaaagcggagtacgcagttcatgagaaatatccaccatataatcacggcgcatttgttcatttttttccagtgtactggcaagccgattaaagtctgatgctaattgaccaatctcatctgtactggatggcttcacccgaacactgaaatcacccgcagcaagtttatgtgttccttctaccaaccgtttaacgggctttagaaaaccacgggacaggagaaaagtggcaatcagcgccagcaaggttgaaaaaccagcgataatccaactggttaattgctgctggtggtcaaaactgatatccgcttgacgagtgattttgtctgatgtgctgacaatgacccatccgacgatattattttgataaatcactggtttccgataggtgtccgtagggatcttacccgaatgaccgaccagacgaagcattttattgtcaactacccagaattgactgcgccagccacgggatgacgggttttggtggctatcactgttttgttcaatggctcgaatgagttgaaagatcatccgatcgttttgaagcaggaaatcccaattaccatatttctggtattgttctgtcagtgcttctgccattttattggcgcgtatttggctattctgcttgatataaccaatgaaactatgctggaagctgaggcgaatcccccagtgcattgtcaccagcaccagcatacaggtcgcgaaaatagccaaaaatagcttaccactgacacttgttcttatcatgtgtctcatgatgattttaccacctgagattttatcgtacggcggtggtgccattttttacgcagtcggtcaaaaaacagatatacaacaggcgtggtatataatgtgagaagctggctcatcactagccccccgacaatggtaatacccagaggctgacgcagttcagccccatcaccactattcagaactaaaggtaaggcaccgaataatgctgaaagggtagtcatcataattggcctgaagcgcaataaactggcctgaagtatcgcttcttgtgcactcaattttccgcttttctgcgcttcaagggcaaaatccaccataatgatggcatttttcttcacaatgccaattagcagcatgatcccaaccatggcgatcagactaaatggtgtgttgaacagctctagtgcaagtaaagcgccaacacccgcagaaggcagagttgaaagaatggtcagagggtggatataactctcataaagtacccctaaaaccagataaacggtcacgatagctgcgaggatcacccacaattgtgagctctgagttttctgaaaatcttgggctatgcctgcgaaagagctgcgtactgcggaagggacactcaactctgtcattgttcgttctatcgcactgattgcatccgacagtgtatagttttctgcaacattgaaagcgatagtcgaggaggctgacagcccctgatgataaacacctgatggtgcattcgcaggttgccagcgggcaaaataggaaagtggaatacgttcacccttggcattgattacaaacattttttccaacgagctggcatcttgtgtatattcaggtgcgacttccataaccactttgtattgatttcggggcagataaattgtggaaatagactgctgaccgaaagcattgctaagcaaggcattggcttcattgacactaatgcccaaacgagccatcagatcgcgatcatagataatggctatttctgagcctttattttcataatccgaattaacatcagtcaattggggcaatttcgccaatgcttttcgaataatcggttcccatttgcgcagttcaccaagatcatcggacaacaacgcaaactgataaattgatttcgctccgccgcgtccacccaatttgagttcctgaatggggagcaaatacagttgggcacccgcttcattcgagagtttcccttttaaacggatgatcactttttcgatactttcagtacgctcttttagtggctttagtgctataaacataaatcctgagctgctctcagtaaatccctccacattttcgaccgttggatcggcattaatgacctgcataaaatgtttcatcttgtcgcgcatggactggaatgaactgttttcatcggcaatgacgaatcccaaaatccgtccggtatcttgctgaggaaaaagggttttcgggatgttgatatagagccaaacattcagcacaacgatgccaattaatgttagcagtacccagcgggtatgattgagtacccatttcagagaacgcccatatccctgctgaatttttaacagtaccttgctaaaacctctaatgcgtttttgcgatttttgcggtgatgatttgagcaggtgtgcgcacatcattggggttaaggtaagagaaatcagtagtgaaattccgatagctgttgcgagtgtcacagcaaaatcgcggaacatcctgccgagtaattcatcgatcaatacaagcggaatgaaaacggcgacgagtgaaacactcatggcaagaaccgtgaatccaacctctctgaccccctttagtgcggcttgggcaggcttcaacccagcctccagatggcgggaaatattttccagtaccacaatggcatcatcgacaacaaatcctgtcgcaatggtcaatgccatcaaagaaaggttattcaggctgaaaccacataaatacatggcagtaaatgtaccaatgagtgatacaggtactgcaattgcgggaatcagggtggcgcggcctgaacgcaaaaacagaaaaaccaccagaatcactaaagcgacagcaatggcaagtgactgtttcacttcttgcagggaggcacgaatggtcggtgagcgctcctgtgcaatattaaactgaatattggcaggaatagattcacgcagaacaggaagttcagcacgaattcggtctatggttgcaatgatattggctcccgattcacgacgaataaccagtacgatggcgggctcacctccggacattcctgctactcgggtattttcgacggaatccttgatattagcaacatcctgcaaacgcacaggagaaccattacgataatgcacaataatagaacgataactgtctgcgttcttcagttcgtcattggtatgtacttgccagttctgttgcgctgaatccacatgtcctgttgggcgttgggcattggcactgttgatggcttggctgacatcattgagtgaaacaccctgattaaacagggcattgggattcagttcaatccttaccgcaggcagagaaccgcctccgacagacacattactgacaccttctacttgagaaagcttttgagcaaggtaggttgaggcaatatcatacagttgccctacactatgattagttgacgttaaagtcaaaatcataatcggggaatcagagagattcgccttatagtaccttggccggcttggcataccggaaggcagcaggctttctgctgcattgatcgccgcttggacatcccgtgcggcgccattgatatcccggctaagctcgaattccagcgtaatgttagtgttacctagcgaactgttggaggacatctccttcacgccagcaatcttaccgagtgaacgttccagtggtgtagcaacggaagatgccatggtttcaggtgatgcgcctggcatgtaagcactaactgaaatgaaggggtagtccatcttcggcagcggtgatacaggcagcagaataaaactgagtgcgccacataaagtaatggctaaactcagtagcgtcgtggcgacaggccgttggataaatagggcgaaaaacttcacagcggctcctgatgattaaccggtgaatgatctaattccctttgattctgactctggagtctgttttggcgcttgtttttaaaataattcgctaatcggtcaaataacagataaataacaggcgttgtgaatagcgtcaggatctggctcatgatcaatccgcccaccatacagatacctaatggacggcgtaactctgccccgattcctgtactgagcattaacggtaatgctcccagcagtgcagccatagtcgtcatcaaaatgggtctgaaacgcagaaggcaagcctgaaaaatcgcgtcataaggcgacatgcctttttcacgttccgctgccagggcaaagtcgatcatcatgatggcattcttcttcacaataccaatcagcaaaatgatcccgataatggcaataatatccaactcatagccacctaccatcagggctaacaatgcccctacgccggcagtgggcaaagttgacaggatcgtaacaggatgaataaagctttcgtacaaaataccaagcacgatatacatggagataacggcagccaaaatcagccatagggtattgccaagcgcatcctgaaacgccagtgttgctccttgaaattgcgtattgatgttttttggcatcccaatcgaccgttctgtttctttgactgcattaactgctgcttcaagggaagcttcttgtgcgacattgaacgaaaaagtgacagcaggaaattgttgcagatgattgatggataaataccccaattgttgctcaacagtggcaattgtactgagtggcactaccttgttatcggttccgatcaggtgaacattattgaatgcattcatacccgcttcattttgtgtatcctgctcaaggatcacccgatattggttagcttgggtgtaaattgttgaaatcaaacgttggccaaaagcgttgtacagtgcattatctatggcagtcatggaaatacctaatcgactggccatatcacgattgacattgatataagccactaacccccgattctgccagtcagtaccaacatccaccaattcagggcgctgtttcagtgcttcctgtagtttgggaacccaaatgttaaggtcattggagacagtcccttgcaatgtaaattgatattgcgtgcgggcaacttgggtatcaatcgttaaatcctgtgtcggttgtagatacagtttgacgtcaggtacgttagcgacgcgagcctgtagacgcgggatgatctcatcaactcggatatcacgctgattgagaggttttaaggtgatttgcagacgcccactattcagcgttgagttgctgccatcaacaccaatgaacgttgtcacattttccacatcaggatcttgcagcagcagagccgtaacttctctctgtttatctgacatggcattgaatgaaatagattgtggcgcttccagtgtaccctgaatcaagccgttatcctgcaatgggaaaaatccttttgggatcgttaaatagagcagggcggtgaatgccaatgtgctgaatgcaactccgagagttatccaaggatgattcagaacccgtttcagccatccgccatatattgcaattattcgctcaaagaagtgttcactggcctgttcaaagcggttatgtttaatttcagcttctgctttcagcatccgtgcacacatcattggcgttaatgtaagtgataccacggcagaaattaagatggcgacagcaagtgtaatggcgaattctcggaacagccggccgacaatatctcccatgaacaaaagtgggatcagaacggcaattaatgaaaacgttaaggatatgatggtaaaaccgatttctcctgctcctttcagggcagcagccatcggtttttctcctcgttcgatatagcgggagatattttcgatcacaacaattgcatcatctacaacgaaacctgctgcgatggttaatgccatcaacgtgaggttattgacagagaagccacagaaatacatgacggcaaatgtgccaaccagagaaagtggcactgcaatgcttggaatcaaggtcgctgttgcattacgtaaaaacacataaatcaccatcacgactagtgcaatggccaataataactcaaactgaacatcttgtaccgacgcacggatagtgacagtccgatctgtcaaaatatccatgttaaccgatttgggcaaactgttgatcagctctggcagcatggcacggatattgtccgtggtatcgatgacattggcaccaggctgacgttgaacgttgataacaatggcgggtttctcatttgcccaagcgcctaatttggtattttccgcgcctcgttcaatagtcgcgacatcacgcagacgaataggagcaccatttttataggccacgatcaaattgcggtattcgtcgatggatttcatttgatcattggtggttaacgtcactgagcgagtcgggccatcaaaactgccttttgctgaacttacattcgcattcattattgtggtacgaatggtttcgctgtttagtccatgtgcggcgatggcctgtgcattaaacttcacgcgcacagccggacgctgcccaccagccagtgtcaccaagccaactcctccgacttgagaaatacgctgggcaatacgggtctctaccatatcctgtacctgaatcatcggcagggcatcagaagtgacggccaacgtcaagatgggaggatcagccggattgaccttgctgtaaattggtggataaggcaggtcattgggtaatagattcgtcgctgcattaatcgctgcctgtacatcctgctctgcgacatccaatggcaacgaaagctggaacaccagtgttataacggaggcacccccagaactttgtgatgtcatctgtttcaggccggatatcttcccgaattgacgttctagcggggcagttacgacagacgtcatgatatcgggacttgctccggggtagagagtcaccacctgaatagtaggataatccacttgaggtaaagcggaaactggcagcatccggtagccgatgatccctgccagtagtattgctatcataaacagcgtggtagcaactggacgtagaataaataggcgagatggaccaccgccagtcattggagaatcagaatgcattaagtattctccactttactgtttgatggctttgatttatccatctgatcgtaagtattggcagattctgattttagtggtttgacaatcgtgataccagtaccttcggttaatgcgtcagtaccatccgtaacgacccgatcacctgttgccaaacctttgctgatgactaccagttgagcattttgtaacccgatggtgactttacgcttgttgactttgttttctttgtccaccttccagacataatgcccctcactactcatctgtaatgcggcattcgggataacgatggcattttccagtgtattaaccttaatctgaatattgacaaattgattgggaaacagcacgttgttttggttatcgaatcgtgctttcattttaatcgtgccagtagtcacatcaatcaggttatcgatactgagtaatttaccttgtgccaattgctgctggttattgcgatcccaggcggtgacgacaacatccttattatttttctgtgctttcaataccgcgctgatatcgttttccggcagagcaaacaacacatcaatcggatcgacctgagtgatgatcacgagcggagttcctccaccggcagatatgtaattgccaacatcaatttttttcagaccaacacggccggaaatgggagctgtaatccggctgtaagtcaattgcagtctcgcatcatcaatacttgactgatcggctttcaggagggcttcatactggcgcactgtagaaatctgcttgtctagatcctgttgggaaattgatttgtttttcgctaattgctgatagcgaactaaatcctgtcgggaattggctagtgttgcctgatctttggcatattgtccttgtacttttgccagttggatttgaaaggaacggggatcgatttctgctaataaatcgccttgcttgacgaactgaccttcatcaaaatgcagggcggttaattgaccagcaacaaggctagtgacagtgacggtattggccgcctgaacagtacctagtcctcccagataatgggggacggactgtattttggctgttgctacttgcacaggcggttgtagcaaatattttaaatcttgtagagattttgatgcctgagcagatttttcttctgatattgtggatgctttgaagtagttccacgcgaaataagctgttgcgatgacaacggctagtaccgcaaattggaaaaagtaagtacgacgtttatttttcatgtgctcgacattctctcagtattgttgcagtgaccagtcatgcagcatcttatgctaaatcggtttaataaacatatattaatagtgtaaccaaagggaaatagccaatgatggagaaaatatggaagttatgtcaacgagttgcctgtcttgggctttggcgtagggtttagatctacacaatgtaggtaaaagtggcggaaggataaaattcgatgatagtgaaaaagacaggcctcattgatcaatcgatgacagataagatggaaaaactaacaataaatcgatgtaaataaaccatcgaaaaacagaaacaagacctcaatcagaaacgcaagacaataaatatcactgtcttgcgtttttattttttcgctatttaacattcatatatacacatcaacatgacgttgattttccgtatatgtgcctcgaagtagtatctaactgaaatcatcaaaatatcagccctcaaccagagatagtggataggtaatagataaatgatcttttaattcacggttttgtgctggcgtaaaaatagtgagcgagtttttcaggagaactacgatgaaaaaagcactttttttgatatcagctacaacattatttttattgaattccattacaaatgcccatgcctatgacaatgtttatgtttttggtgatagtttgagtgatggtggaaatatcggtagattcacaacagatggagaaaattctgaattatacaatgaatatataactcgagaattaactggcaaaaagctaataccatctagacgtggcggaactaattatgcacaaggtggggcaactgccaatggttcactgaatccatcgcatttcctatttaatcccacaacaaaaaaacaaatcgacagttatttgaaggcacactctggaaaggctgattctaatggtctgtatatacattgggtgggcggtaataatattgatgaagcactcgataatgtcgcgaaaggcgataaatatacagcacaaaaaattatcaatgacagttctgcatccgcagcatcgcaggtcaataatcttattaaggccggagcaggtctggttattgtgcctaatgttcccgatattggcacaactccaaaaattatggaggaagtacttcaaggagcattagggaaaagtaaagtgtctgcaaaagaaatcaagcagattctgaaaaaagctcaccaagctatcaaccagtaccctacaccgaatattgctacccggcatcaaatcatcgaaggagtttttaaaaaaattgctgaagatgctgctcctaaaaatccaagcaaagctaaagaaatctataaccaactactcgatgcttataatcaaagtagcaaaattgcttcccaattttctgacgaatataaccagaaagaagaagaccagcttggtaatggtaatattcttcgtgccgatatcaaccacctcttacgggaagtgattgagaatccgaccatctatggtatttccaatacccttggttatggctgcacacaaggtggacttgccgcgttttgttcttcttccgatcccgactttgataaaagccaatcatacttgttttctgatagcttccatccaacaccttatgtacatctgatgataagtcagtacattatgtccatctataatgccccgttacaggtgatgacgttgaatcacatcaatcgagtacccgtcataagtgtcctaaattcacttgatggacacttgcaacaatttcgcaatggtcgtaatgcacaaggtaaaattggaatattcggcggttatacaggtaaccacaatagcactctcacattgggcagtgattatcaactgacaaatgacttgctattaggggcgacagtttcacgttatcgagatgaacaaagttcagcttctaatttcaattatgccgctactggtcatgtcgtaacggcttatgcactctggaactattataaccacggctggctgagtggcgatctccattattcacgcaccaactacgataacctgtcacgttccatccagcttggtcaagccacgcgtagagaaacaggctcaactaccggcaaacagtggggatggcgaatcacggctggctggaatatccctatcacccattacctgaccaccagtccaatcatccagtatgcttgggataaagggaatgttgatggctatcgtgaatccggtaacaatagcacctccatgcattttgaggatcaacactataactctaaagtgggttcagtcggctggcgagtggatactcaattaggccgcttcaatccttacgcttctatcctgttcagtcaccaattcgatgatgaatcttacatacttcgtagcgccattaattccactaaaacttccttcatacaacgggaggaaaagcaagatagaaaccgtttccaatataccgttggggtcaatgctaacctgaccaataattttcgggcatttgcagcgatatcacatgaaaaaagcgataagacatcaaatcataattatggtttcaacctcggtttcaatatcagcttttgatataccgaatgcaggataaaaaaacaggaagaaatgcaaaagaaaattcacaagcaagttagtctccctccccctgtaggcgtatgttggcagggggattttttttacaagaggccatcgccatgaataaataatataaccttattggtatcgatcacggcaaacaggacctgagcccccctaaagtttttgaatcccagcataggacgtgttcgccgtttgatgttgcgataatcctgttcaatcaggtgaaatctttagcaacgctatcaggcgtaacaaattcctcgaattcttttcaaaccaagacacctgcctcattggtatagaagtgtgcggcggagcgcatcattgagccaggcaaccatagattttatgctctacagtaaagtaagacgaattttaaattttttactaatattaaccaatgagtatgttaaagcggtatgaaaacaatgatagctatccgttgatataaatttttccgaggtgtttatctatgccatcatttgcgaaaaaaatcattgggacttttatttttatttatgccttattgataccttctacaataacgttcgctttagccaaagatgctataagacatgagacatcgcatccacattcaaaagaaacacagaataccccagaatttgatgcgcagaatttcattgtcaataatctccaaaccatgagtcaggtattatcttcttctccttcagagcttaagacgcaagcaacttcttatgcgttgggtaaacttaacagcaccatattatcagaaacacaaaaatggttatcacagtttggtacagtaagcattaattttggcttagacagggactggaaactgaaaaatcactcacttgatctcttattgccattgtacgataacaaagccgactggctgttcttttcccaattaggttatcgcaataaagacagcagaaatacgataaatatcggcttaggcgggcgttatttttatcagaattggatgtatgggctgaatacattttatgactatgatattactggtaaaaacaggcgtataggcttgggaagtgaaatatggggggattatattaaactctcagccaatgcttattatcgcttaagtgactggcaaaactcacgtaatttcgattattactacgagcgccctgctaatggctatgatattaatagcgaattttacctgcctttttaccctaatctgggtgccaaattaagctatgaaaaatattttggtgatagtgtcactttatttaatcgtgataccaaacagaaaaacccgagtctggcaaaaatgggtttgacttatactccaattccgctttttacaataggagtggattacagacagggggaaagcggtcgtagtgaaacccaacttttagtgaatctgaattatagatttggtataccaatcagcactcaactagatcataataatgtcgcttcaatgcggacattagcaggcagccgctatgatttggtagaacgaaataataatattgttttggaacataaaaaaatagaggaaatagaactactcgctgtcgaaccaattcttggttatgggcatcaggaaataaagatcagcgttcccgtccgaactcataaaaatattaaacaggctagttggaaagtggctgataaggcatttgagcaatataacggaaaactttcttctgatttaggaaaagacattacggttacactccctagctatcaagaagctcataaacaggattacatcctcgatatatccatcatggataatcaggaaagaattaaaaatacacatatgccaataaaaattttaccttttttgattgatggaaaagtaaaagttattccacctaaatctctagaatcaacagatgaggaaaaaaatggctataaatttactgatttagttattacttatcaaggtgtgattaaaggagaaattgttaaaaatggtaaaattgataatgtgcgctggatagtggaatcctctttaggtgatgaatctgaattaagttttgcatggaataatagaccagctcaaacaaatgaaaaaggtgaattaatcgatgaaaacaggaaaccaatatctaacattttagtcagtaaaaataaaaaccagaatgataaagtcaaagtgtatatacagttagatggtgcgacaaaacaagaaataggtgaagtgaattttgatcctgttaagcccgtaccagataaacctgaaaacattgaggtgaaatgccaggctcagggtgaaactccggtattagtgaacgagtcctatatatgtaaggcaatagtaacgggtgctaaaggtaaaagtgactatatcataggaaaaaaagtcaattggaaagtggaaggacacaataaacttcaaccgatacctgttatcgagcaaactaatgccgatggggaagccacggcaaccttaactagctctactgagctttcaggtcttgttgttatagcctctgttgatgatggtcaaccgacttataaatcaaataaaatcaattttagttggccagaaatcaccctagatccgctgtcgaaaagtacaactgatggggatgaggtggaacactataccgtgagagcaaccatcttgcgcgaaaaaggcggtaaagtatatacggggaatacagagaataaagggaaggacattaagttcgtatggaaggatctgaaacttgaaaatggtaataatgcctccggcgtgacttccaaaccatcaccgggtactcctcaatctgtagattcccagggtaaattggaaactcatattagcggaaataaagcgaataatgaacaggttaaagcgtgtattaatattgaaggtagagattctgcctcagatatatgttctgagctgataaattttgtgcaggattttaagattgatagtattgaagtgattaattttgatccggctagcccattgttgggagatggtaattcaaaatatcaatatagagcaaagattgttgattataaagataataccaaaataatagcgggtagaaaattcgaacctaaagatattagttggatacacgatcataacaaaatagaatcagcaaaacttccttctcctgaactttattcaccaacaaataaagatgtgtatacaacagatgataaaggatatttatatgcgacgttaaaaagttcggtcggcgttaaaaaagttaatatgacattaaaagtttccggagcaaagaatactaatgaggagcttacgacaacggcgggagttgaattcactccggtagccaaagtagcgctattatatgtttataatagaaatgataaaaaaatatataaatattttgataacaaagacaacttgaaccgtccaagtaatgtgtttgaatctttacgaggggagttaagagaccctaaaaatcctaaatctttttatgatgatccagacgtttctgaagttatttatagtatgaaatttaataaggacgaggcgccatatggaggtattacattaacttttggtgacaaagaacatggcccaattcaatttagagctatggggattgtagagatatattcaaacgtaacaatgcaaagtggcgaaattaaattatataaatataaaatagatatcaaaagtgtctcatcagttaataatcaaaaaggctatgtaagtgtaaatgggagtaatattgattgtggggttaacttaaagggaggaaggcaagatttgtattcagataaggaagcatctgatcctactaatccttattctatacataatgaatggggggaaactgaacggggagaaaggtacagtttatacgattggggactcttcgacgaagttaataatcacaacgctgaaaaagctactattatagtaaagagtaccagttctgctagtagtaaacgatttaggatttatgattctaaaaataatactttcgatcaacagtcagagggggttattttttgttatgatcactggttaaaatcaggtaaaaattaagactataccattaaaacactgagttactataaaaccatgtgaagcattgtctatccccacttcacggggatagatacctcacatctttaagcttggttagtatcgagataaaaaggatagtaaaaaataataaattatagtaatcaaaaaaagttatcaattgataattttttttgattagtgttttatttttttatgcttatgctggagagcagagttgagatggttatatagcagtcaatattaaagtttttttataataagtttatatttaaaactatttttggagtgatttttttaaatgtaatgtggttaatgattatctattaataataatatgaggtaataaaatggcagctattactagcacgaaaatttcaccactggcgaatgaattagaggtgggccagaaagtaacattttcagtaaaattaacatcgaataaacctattgataataacaagtatataatagtagaaagtggctacgttcaaaatataaaatttgataacttaaaagttctacttgtcgataaaaatgaaagtgggctttttaccgcaactgccgaatttgattttacggtgcttgataaaatcggaggagtaggggcgaatgtgaataataatgattctatttcatttacaatcaatactgatgcgaaatcggatgcaactgtatttccaaacatgccccacacgtacaatagtaaaattaaagttaagccagtaaatagcaataaaatagatatcacaattaataaaaatgccgatttagttataggtcagaaagtgagtttttttgtagaattaaactcagataatcctattttaccagcaggtaatataaccatagaaaaaattagttccaatataaagtttgatcaagatacgactaagactattccgatttatagccaagttggtaataaagtatctgcgaagttaagttttaccgtacttgatggtgtgtcaggtggagcatctgcacaagatggtgatgctattacatttgtaatccatactgatgcgttgacgtctgaaggtaatttcggttctgttccattcaatggcacagcaaacgaaattgatatggattcactggcactttttgttgagaacccttttctgcaaatgtcatcagaaagtgatcaacaacatcctacggcaatatatacttatttaaagaatagaaatacacagaaaccattggtgggaacacctgtatttattacatcacaaaagcgtaatcaaatagaagaatttaaatttaaggatggcgatgggaacaatcctataattcttgaggagaaagataatactaaaggattaattatcgcttctaaagatgatggtttagtaaagttctatctctatcctcaaacagcactggtaagtgttgttaatttatggagctatattataagttatacaacagatattagacgtgaagctaagcaagtaatctatgcagtgaactatattaagcctactttctttaattctataggtatgcctgatatttctggctatagtactgctggtatacgtgcagattcgatattaccatattttatggtatccgttagtggtgatcctagaatatcaaaaggtgatacggttttattttttgttaataaattaaactctacgaaagctcctaaatttactggctatacggagttgattgatgatcctaaaacacaattagatcggtatagtatgaaacttccttatacgatttttgaacagtctatatcgtcggaactttcttatactgttgttaagccggatggatcagctttatactctgacacattaccagtaacttatttaggaggaacaccatatgtacctgatcaagaagctaagagaagctatgagctttgcatagttcaccccagtactggtgttgatcctgatgtttttataccagctgataatgatattggttatgaaaatattaagaaatatcctcatcataaatatgatggattatttattgaaatagtacgtttaaaatctaacgatgctgcttcaaaattaaatccagttccattaaatataaaggatattactctgaatatgtatattaattcagataataaaaacttcactaaaccttataccaaacagattaatttggcagatataagtggccctggtaataaagactctattttctttcatattccatatgatgatattgttggtgttaagtggagagggaatatcagttttgattatcaattctttaaagatgaggttattcagtatagtgctgtttggaatggatatattggtaccgaaccgcttgatggttctaattaatcgaaagagaatgtatgtgtgatgtgatttcataaagtagtggaaatagtattttattataacgaataactgaaaataataaatttccttgctcctaatatatcaaggagtaaggaaatgtttggaagatagttatatttttattttatatataatataaaatgtttaattaacttactgtggtaaagggatttttttctatagcatagataattaaaaatatgaagtttataagaggaataaacatatgtctaatgttatgactttttcacagccagaaacggggaatttaatcatagggcaaacttttttatttacagtgatattatcctctgatgaggttatagatggcagttcaataatttcattttttaatactaaaaacatttctgtaccaattggagatgtttccgtaaatttggaaagtgacaataaaaaagccacggcaacagtgacgcttaccgtaagtaatttgatagcagaaaatgaggagattcattttagtgtaaaaacatcattaagtggtattcagcaaaaaaaattgcaatatcttgcaaaagaaatttatcctgaatcattgaggttgagcgttgataatgcttttttatcagtaccaacatcatatgatcattctcaaataggtactgtatcaactaaagtacacaccattatcaaagataaagatggtaatccattatcaggaattccgatctttataaagagtagagcatttaatcagctagaagaagtatatatttatgctaatgatgtaagaaataaaataaatgttcaaaacctttctctttattctggtttttctataaattcaggtgataaaggtcaggtggaattttatatttctccaattaaaccactggcattagttattgacttgtcttcaactataaggattccatccgattatgctatttctcatagtactgttttcatcatttttgataataagaaatataaccgacaagaacctgaagcggttactgctattgatggtgatttaacatcgaaaggagaaagtaaattttggctagatacaacaccatgtacagcttatgatgttgatgattttttattattcaatattaatggtgaatacaagtattatgtcagaggatttgatgtaattgaagacaatcaatgcttaattaaattaccttactttattcttgagaaaaataaattatcaaatctttcttatcttgtaataagagggaatggagatattatagctaaatcctatcctgtagatgttacttacagaggaaggacaaataaaccatggacagatgttgatagaatatatgaaccctgtaaggtttatactagctttaatgatgttatagagcaggatggtgatataaacaatcaaaaaatatctaaccatgcaaaaaatccagatgatgctggcttgtttgttacaataacaggaactaatgataatagtgataatactaaagtaaaactcggatcaaaagttactttaaatttatatattaattctaaaaacaaaacagtcacactaccttttaattgtataatgccatatcatccagataataaagatggaaaaacagcggtattaagatttaatatacgttataaattattaaatggtcattttgcatttcctttccatgacgggatgatatattttgattatcaggttggtgatgataatgatagggatgtgacgtatggtggtatttggtctggtcatatcgttacagattagaatcaattcactaggcatatatgtataatttaaattacattaaaactatgtttaaaatggtgatatatgaatataaaaaataacatcgttttatctaaacctgaattcccccaaagtgattcaaataacgtcattaatatccttgaagttaaaacgatgggaattaaatatttagtaatgaaagtgaataaatatgatggagtagagctattagatagtatagatggtgaactctatctaaaagataattcaaagattaaaataaaaagcattacttactgtgtaacgccagatgttttagataacgactatgattattattctgtgatttttaatgtaaacgattttcatacatatggattatacgaagcagtatatacagtgacaagtttaaatgacaataaaaatacttcaccaatttcaagtgttaatattatagaggacccttctatgaacgcttcagataatgaaataacgtttactgacattaaaaatcgtaaattatatttaagtagtatttctcgtgaaagaggaataaggattcgtacaaactttaaaggttttacggctggggataccatcactattacattaaagattttagatgaagaaaatagcccaataaatactttaaaatctgacaaagtattgctccaagatcaggtaaatcaagactatgctgattatacaataagcacaggtgagggtgggattaattttgtagaggctaaatctattttggctggtttttatagtgctgatattaatataacatcctctttatctcaaatttctatttataacgatttagataatgttaatgtcaaagtacaattgactcaaaatattggtactagtagtgaatctcctgatgtaaaaccttttttaacagcagtagtgtatacaggatcaaatagcaatgcaattattgcccaagtatccaatgcttactttagtgatggttctaatagaaccccactgggggaaataaataacaatggagtggggtatctgaatatttatagtaaagatattgctaaaaatagtgttctaactcttaactatctagatcctgttaatgcttataaggtttgtttgaatttttcggtttggttattatcatcaagtgaagaaattaaatatacttatagctcttatggtgttgcagatggaacgtgccaatgtttcctttttattgaaccgctaataactggaattgagactattaatgttaagtttgatacaccagatatcataattgatgatgttgttaagagttctataccaataaataatcctgtttctaataaaactttaagctataaaataacttcaaataaagcatttagggctaatttttctattaatgccagtggtaaaggtatttatatggaacaaattaataacactatcgtttttgtcgatccgctaacatttgagtaaaataatatggctattacaataaactttactccatcatatgaagtatttcaagatagatcggcggttaatattaatatattagcttatgaatattcggagtcattacctgggttagagattgtttttgaatgctcagtcggtagctttgttgttaatggtgaagatacaggtaaaaaaagactttttggcaagattggcggcactggagaaacatctgtcttggttgtggggccaatgacaggtggcaatggtcaactgactgtttcccttagggagaataataagcagattggcatattaccttacgatctaataacaacagactatcagcttaactttagtgttactggtgactatgcaatggcagatggtaaacagagtaataaagttaatgcgattctgacgggaatgggaaccgtgtttgatctcaaaaaccgccagttggatttaattgtgacaggttctgcttcttttgagcaaaataaggtaacccagaccacttctattaatactgatccgttaggtaatgtgagttttgaactttatgatgcaaataatagtggtgagactgtcaccctggcaggccaattgagtggtaataaaatatctcataatacggaacaaattcatttccagcctaacctggattgtgatgctcatccccctagtaacgaaatatatattagaacaatttttacttattctattaataatgatcaataccttttacgccagcgccaatgcgatcatttggtcactgtacataaattgcttgctggcgggaaacagggagagcaaacttcgaccgggcaaaagtgggtaaattattatgatttaatgttcccatttgttattgagaatgagcaatatgtttttggtttagccaaggactttattaatgcaccacaaaatacagataaatcattttggatgattgcaaagttggatgaaaacggacagaaagaaataatagatagtggatattttgatgttagttatgatgttgggtttgcatataatattggaggtagacagtttatcttacttcatggtaaaggaaatggatggcctattatatgttacgaaatttttacaaaagtaaaaatgaatcgtaaaccgatatgtcaacaaaactgggataatttttacggagttgtattctttatttcaatggaaggtaatcaatatatatactgtcatacaaagactactaaaaatatttatacatttgagtttaacaaagatggaaccttaggtaagctagcatattctgatacgtggtcatattattactatcctcagtttccatactttattaaaggaaagtattattacactggtcagagattctatgataactattggtttatttcttacatatatagtaagggtgttcctgagcatgttaacgaacacgcagaaccatgggatacgagttatcaatatttaattccattttccattggtgaaaatcaatattttttgaggcaaaaccaaagtaaaaatcattggtatattacagagattattgctgatactaaaatgggagaagatagggattctaggtgattagtcccagattttgatggaacgatagtaacgattgctgttcaggcgttttgatgctgacgaatcgcatgttagtgctacagccgtaattgctctataagcctatgatctcaccagcagggaggttttatcgattgactacgcaaataacaatcaaccctacatttatttagactttctctgttaatgcgacagaatcggtttttagccagctcactagccaaggtgtgtcactgtttttcgttcatcttgtcacctgttctcgttgataaattaaacatattaaaaacaggcaatgacacaaatttagaaacgggatcgaaaacgccgatatcatttataaatcggcgtttctcccatgaagctcaaatcaaaaacagcgttgccaaccccaaaaagataaagaatccgccagtatcggtcattgccgtgatcatcacactggaaccaatggccggatctcgccccagtttcatcattaataaatggaatcaatactcccattagagctgccatcagcagatttaatatcatttccattgtcatcacaccgcccatcgcaagatcgccatcgagtagacaggtgacaacgcccgaacgatcatggtaatggtctggttgcctgtgttacctcctatacctgccaaagcaggaattaaagcccggcaaatttagatgtgattgccctgattacgttttggctatattgccagcaccttccattcggatttggtgcaatctggctgcactatttattagcctcattgacggatttttctatatctattttttttgggtaaaatttatacaaacacttaatatcttcatatatataagtttttttagttgtcacttatctaaatgggagaattacaccgtttttaactcattgatttaattaaattcacgtttcatacaggaattacgcaaactcaacaagttatctaaaggtcagatttctgccctatagtgacagccatctatcttctcattctcattctcattttggaactactctcaacttcttctatctaatagtatgaaatcaatttctaagagtgtatcccaataggagatatttgatattatagtcagcctgtttttttacatttaggggattttttcatgaataagaaatcaatagcccaatggttcatttctgatgaactctggcagaaaattgaacccttactccctccacataaaacccatcaccctttgggctgccatcgccgccgtgtcgataatcgggccgctatgaatgctatcttttttgtgttacgaaccggatgccagtggaatgccctcaatgccacagggatttgttcttcaagcagtgctcaccgccgttttcaggaatgggtggcgggaggcgtctttgagcgactctggcaaaatggcttactcgccagtgaaaaaataggggctatcgactggggcaaattggcactggatggctgtttgactaaagcgcccctggccggctcaaaaaaacaggccgcaacccaacagaccggggaaaacaaggcgtaaagcgaagtttgctcacggatggacagggcttgccattagcgattgccgttgcgcccgctaatattcatgatatcagacttgttatagccaccctggacggtttacagacaggacgccggggttatggaaccaaactccatctggataaagcttatgaggcggaatggctggaaaaagaattaaaaacccgtggatacgtcccctgcatacaatcaagaaaagaagaacaagatgcgctggccgaacaatatgattttaaagtgaaccgttgggttgttgaaaggacacacagttggcttaatcgttttcgtcgtattctggttcgttgggaaaaacgggttgaaaattatgaagccatgcttcatttggcttgtagtttaattgtctggaatataatcctattgggataggctcttagaaggaatcatttgcatattgttttgcagatttttcgaccttgtttagtattttgtgtaatcaccacttccgattaaatgtgaccgtccaggtggttagccccagatcgataaaggcggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccctattgtgtgggcactgatacccccgaaccggcggcgctcacaccgaatattgtgctgtatgaccaccaggccagccgttcaggcacctgcgctgctgactatctcgccggttttcaaggttatctgcaggtggatggctatcaaggctatgagcagaccggtgcccggctggtcggttgcatggcccatgcccgccgtaaatttatggaagcgaagcaggcgcagggaaaaaacaaaacgggcaaagccgatatcgcgctgagcctgatccagtcactgtaccgggtcgagcatcaggtcaaggggttaagcccggcagaaaaataccggatccgccaggaaaaagcgcttcctatctgggataagttatcggcctggctggttaaaacccgatcccaggtgatccccaaaagcaagctgggtgaggccgtcacttatctgagcaatcaatgggcaaaactgatccgctatcgtgaggatggccgcttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtagtttagttgacgcttacagttgacgcttacggcgagccggatatcgtctttggtcacttcgatatattccagtgtcttgccgcgatgttctgccgttttgatttcccgctggtattggtgcaacagcgcgatactctggatcaaggtgagatatttcatgtggtcacggcgggtacgggtcttggcgacgacaaaagcaactaagggcagggaatgagctgctcttaaaaaagaaagtcggaagatcacggggatcttccggctgatttcatgatatttacatagtcttattgtaaaaacttaactcgtattcttcttcacttattgcaataactttcattggatttagtaataaaacatacaaatcaaaagttttctttaatgcatagcagctagataaaaatctctttaaatcaataatattgaaagaaaactttaccattccttcaaaaaacatgtagtaactattacattcaccaatatgtattttagattgcagatatgagtaaatatcctcctcagatacaggaagttctagcttgcattcaggtatttcttttccttttaaaatactattgattatctctttatgccactgaaattccttatcattattacttaaagatatagatatcttttcaatcccttgaatgttattgatatacctctttgctcttgccaagagcattttttcttctaatttactattcataataaatatggtgatcatccgttttagggtctgttattttctgatatctattctctttaaagtcatacgttcttgggtctgcgcctgttttcgcttgacctgcatgggcatgtggatgtgttgctctaggatcagccgtatgttcaagtacaacttttttatgcccatgtgcatctttatattcgtaatagcgaccatgagaacccagatcttctgaatattgataattggtttgtcctcttcgttttggatcatttccaacagtccattgtctatctggtttttgagaacgaggtattccggctaaatctttagctttatttaaggcttggcgtcgatttggtttgggttttccacagttttcacctgctaatcccagcgggtcgataaaattcgtcggattatgcacatacccatacggattcagcccgcccaataggccaatgggatccggcgtcaggtactgcccagtttcccggtcataataccgaaaacgattatagtatagcccactttcctcgtcttcgtactgccccacaaaacgcaggttgcagctaacgtgataatccgcatcattggaggccagcacctgagatttctccgccctgccccacgtcgtcagccgctgtgcccacaccagcccgccttcctcgttcagcatttcccggggcgtaccctgatgatcgctgacgatgtaatgcaatttaccccgttcataacgcgccgacggcgtaagtttacccggttcgtacagccagcggatacgctgatcttcggcgggcgtgccatccgcatacaatggcgtttcctcaatcagctgatccccgctccacaggtaatcctgccccatcatggtacggggtttcggcgtcagatccggcttgccgtccagccagcgctgtaaattggctgccgccagttttccgtcgtgcaccttgagtttgcggatacgccgcccgaaagcatcgtactgatagtaccagcgggaaccgtccggggtttcacactgggtcagctggttcagtgcatcccagcggtagcgccacacttgtggccggaaaccatcgcgctgtgcggtcttttctaccagccgcccgctgtcatcatagcggtagctgacatcaccgcgccggataacccgcccggcctgctggtgctgggtaatttgcgtcacggcgccctgcgcgtccaccggaatatgctgactcaggttgccattggcgtcatagcggaactgctcctcatacggccgggccccctgatacagggtctcggttatctggttatttgagttataacggtagcgggtctgcccccagcggccgtcatcaatcacccggaggttatacgcccggtcatactgccagctgcggttcaccgccgtggcctgcggcgggaaatgggggtcattttgttgcagggtttcacggaacatcgccgtgacccggcctgccgactgatgcgctaacatcccggtggcggtgtagcggctggcgaggatgaagccttcaccactttcacgcgccgtttcacgcccgagcgggtcatggctcagtgtcaacggactgtgccggtcaaagcggaagccggtcagtgcgcccatccggttatagtcaaaatgcagggtatgtccgtcaagggtttccactgccggcaagccggtgagttcattccattcccgactgatttcccggccattcagccgttcgcccgtcaggttccccgcctcatcatagtcaaattccaccaccgcatccggtgacaccgcgcgggtcaaccggcggtggacgtcatacgtgtattcggtggctacctgcagctcacaagacgatgctcccgccagccagtgctcctgccggctgagtaggtcttcagcggtgtaacaaaaacggattaactgaccgttcgggtaacgcgtcaaggtgcggcggcctgcccggtcatagatgtattccaccgtccgcccggtaaaatccgtttcacgaataatctgcccggccaaatcacgttcataacgatatgtttcgccggttgccatcgtcacgcggttcagccggattaggcggtcatactcaaaatgcagcgtggttccatccggccgggtcattcgggtcagcaaatcaaatgccccatacgcatagcgtgtggtgttcccctcaccgtccgtcaccgccgtaacccggcgctcgctgtcataatcgatgtgctgctttaccccgtccggtaactcaatttccgtcacacttcctgccgggctggcatgaaacgcactgtgctggtaacgggtctgctgccccagcgcatcagtcacgccgcgcagccgtcccagcccgtcctgatcataacgggtggtatacccattgggttgcaacacctgatgcaaccggtgctgctcatactcataacgccactgcgtcccgtccggcaatacccggcgcagcagttctccatgcaggttataacggtattcttcccgccgtccctgtgggtcggtcaccgcatccagggcgccctgttcgctgtagtgaaacccccagcttttgcccgccggcagtgtggcctgcaccagctggccgtactcatcgtaatcatagataaacacctcaccggcaggcaacgtcagttgggtcagttcaccgtacgggctgtactcgaacgtggtttttctgcccagcggatcggtttccgagagcttatggctcaagtcccactccagaacggtttcacgttccagcgggtcaagcttacgggtgatttgaccgtccccgttataccaatagcgggtgcaacccccttccgcatcccgatacgtggtcacccggttgacttcgtcatacagaaaacgatcctgccagtagccctgcggggtagaaaccgacaccaccctgccccgggtgtcatagcccattgacacatcggtcgcatccgcatcatgccagcgggtcatgtgaccgtgagtatcatattcatgccacaggtggctgtgctggaaggtcgcacattccgacaggtagccctgttcgtcatactggcaggtgaccagtcgctggcgcagttcgtccgtcaggtactccacggtcaccagccggtgctggtgataatccagcaacagacggtagccgtcagaatgcgtcacctgtgccaactgagggatcccctcatcgttcaagtcgtcataatggaacgtgatacggttgtcatagcgatcgctaatagcggacaacaaacggcgtttgccatcccgctgctcaaagctcagggtcagctgggtctggcggtcaaacaggtgcagactgccacgcaattccccaaacagcaggtaatgcccggcatgcaggttgaccgagaagactttttcctccggcgtatggaaggtgtagaccacaccgtccgcatcggtaaatcgcgtcgcttcaccgtcgagaacaaggtgctgtgaccagtcatccgcccattttgccccgaacagcccggcaaaatccgccgtcgagcggtaggttcgggtcagtgacaacggtaaggtgcccggcagggaaagcagcggccattgttgcagaaaatcccccgtcgccatgtccaccggatcaccacagcaatcctcttccttgggctttttactattcttttgcgtcgattccttgggtttatcagacttggtgacgcctttcttattacgcggcaacggcagcagtccggcaatcaccaccgcccactgcaaacctttgttgctttcttccatgataggatatttgccatcggtggcctgggtaatggaaatcgacccggccgcactgttgatattggcgtcacaggtggtgcggtggcccagccgggcaatcccctgcccattggcaaagacggtcttggccccttcggctatcacgccgggcgggtggtcactgcacgcgaccgggtcgccgacccgggccaccggcttgccctcaaagaacacatccggtgaccccgcaacaatggtgcccgtattgctgccatactggccgatggcggcgccaatacccgcacatgccccgcccacaaagccgccggccgccgccgccgcggccacaacaaccagcgccgcccctccggtggcgatgaccagcgccgccaccgcgatggccgccaccgcccccaacaagataccgcccaatgcgccccacaaacccgcattcttgttctggtgcgctatcgcatccccttcccgggccggattttccccttctgtcgccaccgtactcatgcccatgcccgccgcgatagcatggccgattttatcgccgacatacgcccccgccgctgcaccggccgcaccggccgccaatcccaccgcaaaaggtaccgccgccccggtggcaaccgcaaaggtaccactggttgccagcgtcgcattctcaaacgtctcactttgcaggaattctaatgtcttatccgaggtggatttttctgtccggggcggggccggcacccttctgtccccctgggccggcgacggacggcggttggttgcggggggtggggacggccgttgtgccgctgccgcccccatcatgacattctgtgaaacactcatgttgtctctccctgttattcgctgcccttctgctcactgcgcagctggaacgtcgccatcatcgcctgcatctgcgccttctgagccggggtcatttccccctgacaggtgccggtgaatatcaacacctgaccgggcgcgttgagcatcatcatcagctgatgtaccgggccactcggcgcccgccagcggaactcaaacgtctcggtttcatggccgttcagttcgccggcctcgtgggccagaacctcatagtccttaagctgtttgccaatcgcggtcatttcccgctcggcaaactggttgaatgctaacccccacggcaggctgtcgcgggaaatggtaaagctggtgccgtttttatcatccgggctgttcagcaccagaatgctcgaatcctgccagctggccggcaatttgatagtgccggcgttgaagtggaagggagaaaggtcaagcgggtcactcatggtcaatcctttttattgcttaccgtttcaaaataaaaatcggtatgttattaatgcgggtcaagatatccggcggactgaactgcggctcgccggactgcaagttttcagctagatatcatgatggtgttcggaactgctcaggccgccgttgaatctgagactcattagcaggagaaaaaacatcgtaattttctctttcaaattctgatttcatataagaaaaaaatcatcatctgccagtgataactactggcagaaatatcaattactctttagaaattctatcctctgagaaaatgacttctcctttttttgaaatttccaatgaaccatattgatagattgtgtatgtcacatctttatttttaaattcatacccataaaaatcgcatgttcctgtattacagtctttatttagagtggttcctttcagtgttatggaggcattatctttctttcttacccccgtatagatcacattgtcacaactgacgtttccttctgggcaaagcacattaatggtaatatgatatgtctttgtttcgaacacatcagtataagccgcaaataacatagatgagcatgccagcaacatgacacctaagaaggataaaagtgatttctttaccatctttcataaactccttcgttatagatttttaactcagctgcgcgtctgtttattacgccctgattaactttgccttgcgatttattccaagccttccaggcatcatccagcgtgtcatagtcggttttggcattttcatcatttaccagttttagaacagatgaatcattgaatccttttgcaccaatgttatatgcaaacatggttaaggcatcaaactgattctggtttatctcttttgtaattccgtcattaacggttttctcaaaaggtgccagtgtctttttaaataactcctcagcctcatcttcggtaataccgtctttataggtatcccagtctttcttctcaattaatttaccatagccaattgtagcgcctttagtccatttggtgacggttttccctgtctggtcatcataaggttttaatctcaatgactcgataccttttaataaatccagtccatcttgtcccatggtctttttcgtgctggtggttaaattagttgcagatacagggggtgctgatggtgccgctacctgagaaccagcaggtactgcttgtcgccctgccccattgactggaacaggcatagatcttggagcggatgctggcgttgcctgagagtcagcaggtgctgcctgtctccctgccccatcggcgggagtgggcataggtcttggtgctgatgctggcgttgccgccgacgcggaagaaatcagccccatcgatcccagagccgccatccccatcggtcccagacccgccgccatcaccgctgccggaagcaaacttccactctccgaagcactgtcacccccgtctgcggcggccggcggcagtcccgctcctgcactgccgttgttcaacccaatagccgggccatccacaaagactccgctgctgttcagcaggataaccgatgagccaaatgccacccggatatgctccggtgtcatctcgatgctacccttacccacctgcagagtgatattatcctcagcctgatacagctgcgttcccagccccgctttgcccgccttcgccttcacctgtatcacgttggcctcggtgctgcgggtttggcagatggtctccgtcagattgccctgtttaacggttttgtgctcatcccccgtctggacagtcagcgtgcggtcacccgcctccaccaccaggctctggttatctttcaccgtggtgtgcatgtccttctgcgcatgcagcgccagcctttcactgcccttcgcatcctcaaacagcagttcgttatacccctcccccttgtgggtcttggagcggaacgccatctgggtcttgctgcccggcagcgcgcccggtgggatgttactggcgtgatacgttctgccggtcacaatcggctggtccgggtcgccgtgcaggaagtccaccaccacttcctgaccgatgcgcggaatcgccagcatgccccagccctgcccggcccacggctggctcacccgtatccagcacgaactctggtcgtcgctttttccgtatcggtcccacgggaactgcagccggatgcgcccgtactggtcacagaagatttcttccccggccggccccaccaccttggcaatctgcgggccgtcaatggtcggtttcggcaacggggccggccgccagtgctggttgtggcggatgaagctgaactggctgtgcagcgtggtgccgctgtcgctgctggcggtttcccgcgcctgcggctggctgccggtgtggctcgcgcccaccacctgccacggctggttcaggtcttcacgcgggtggttaaacagggtaaataatttgcccggttgcacggcaatggcctgcccgctggcctgtcccgtcaccgcgtcactgcgcagcgcttccagccggtagcgggtgaaggcctggccgtgggcttcgtccttaaaccgccccgggtagtcgtagtgctcgtagtacatctgctgtaaggtgtcttccttcatctgctggctgaattctgccggccacgccgggtttttgaaggtgtagtccttgagctgcacctgtgccgggcgcacctgcgcactgcaggtaaagctgcccaccgacggtgtgcccgtcgtgctgccttcccccggctggtacgccagcacaatgcccggcggcacggagccggcgtcatcggcaaacaccagcgtgttacggccgttaccgcattcgaagaaataaaagatgccctcttccgcggtcagccgctggaggaaggcaaagtcgctttcctgatattgcacgcagaattcccgcgccggatgcggatggcgcaggctgaacaccacgtcgcggataccgtgctctttcaaaagcgtggtgaggatagcggcgatgtccagctgctggaagatacgcgagttctgccgcagggtggtgcgccacaaatccgggtagaggctcatctggtaggtggtctggtgcaagccggtgttgccctgctcgaaacgcgccactatcccggtgatactgcgctgctccaccccctcctgcagaatggtcagggtcgcgctgcggtcgagcaccgccggaaagtcaatcgccgggtcggcactcgccagcccgacatgcaggctgaacggccgggaaaagccttccgtcagggcgaagtccgtcacgacaaaggtttccggcggcaggccgcccgccgtcagggtaaactgcagcccgctcggggccatgccccccccgccgcccaataactggccggctttttgcagcgccttggccgccccgctctgaccactcgccgcccgcgcggccagtccctgcccggctccccccccggcaccacccaatccgccgccaaagccaccgcccgggattaagcccgccgcgccggtgcctgctgagccgcccccgatacccccgccaaagccgccgcccggaattaagccggcggtgcctgcggctgcgccgccaaggccgccccccagcttaccagtgacgtgttttgccagctgggcggcctgctgtccctgctggatcagcgcccgccctttcttcagttttgccatattctttttcatcgacatcgtctgtctccctgattaatgcccgccgtcagggatgacggtggactcatggtgggtggtctgtttcccggcctgtttttcagccggattttcggccgcctgacgcagccggtcatagcggccgagcagggcgttaaagcggtcatcaatgcctttcagcagcaccggcggcacgggttccccgttcaccacccggccgttgagctggcgcagcagttcttccagcggcacctcgctgccgtggctgcgctggaggtcatagaccgcggttttcaggtacgagagcgtgaagctgccccgggtacgctcctgcaacaggattttgtcggccagttgctggagctggtcgcgggtggtgtgccagctgcctttcagcgggatactgtcgatacgggcggtcatcgcctgtgtccactgatgggtggcgttcttttgctcagccgaatccggccactgctgcgctgccgtgccggtcagcgtgcgggccgcgtcccacgtcgccagcaggggggtttccgccagccggtccagctggccctgatagcccgccagggcgggctcggtcagccacgccagccgggcacccgccggggacgccgtgatagcgctgagctgctgttgcagcggtttatagaacaacagccaccccccgaccagcaccagcaggccgagtactgcgccgaggccaaaaccctgccacgcattccaaccccgcggcggctcaggaaactgcacccgcacccgcgggctgtccgcttccggcgggcggtcaggccgtggcggtgcggacggcggaggtatttccggctcggtgtcggactgggacaggtagaccagcggcggcatctgcaccggcgactgaaccggtttcgcggccggccgcggtttttccagttttttcgccgcgttctggaagaaccacagcaggttctccacccgcggcagccgtttcaggtcggactgctgcaaccggtcgataatcagctgcaacgcccgctccgcccggtaaatcatccgcaggtcgccggtgccgaaatccatctggcgcagctggctgccggtgcgggtgtggaaccattccagtaaatccgtgcgcaccgccggctgcggcggccacagggcgtcccactcactgactatcaccccggccagcagttcacagccttcggtaaagcccgccagcccattgagctgcatccgcgccagcgtgtagtaaatcgccgtctgcaaatcgaccccgttacggcggaacagggtcagtgacagcgattccaccagcacccagttcacttccggctgcgccgggtggctgattttgttgatttcgtcgcggataaccgcaaattccggcagattctgcggactgccgccggcccggatgattaaattctcagggtgttcgctcatgctctggccttcctcttttaaaaaacccccgcccggaggcaggggggatggttcttgctgaatactgactgacacccgccgctcagtagagggtgtccggcagtctgaactggctgaacaggccgcccgcaaacgggttgtccgattcgtccacgtaaatgcggtaggttatctcgccgccgtctaccgcgaagcgcacgtcaaacgcccccggctgcacgttggtcagcttgccgctgttaatcagccgcagctgcgcccacgggccggtgaagctcaggctgcgcggcgccgcgttgctccggtccggcatcagggtcagccggctttccgtgcccgcccgcatcgagttcggccacaccagatgcgccacgttgctgcgcccgtgcgcgtaatccaccagctggccgtcgaggttcagcagaccgcggcgtttgttgccggtcaggctcaccggctcgatggcaaacgccgtgcccagcccgttctgcggggtgaagaaggtggtgcggatacggtccgccatcgccagctgtttcagcacatccgcccggataagctcacgcccgtcggtgccggtggtcaggttgttttccacgaacggtttcaggctctgcttatagaaggtatccagcgtgccgtccggccggaagaaacggtcaaactcactcagcggtacgtcttcggtggccgccgggttgaacggataccggccggccaggtaggttttatactgtttgaccaccgactcattccattccacttccagcgagcgcaccgcttccatcatcaccacccgccacgcctgctcggccagatcaccgacccagcggttcagcggctccggcaggtttttcgccatctgctgcacttcaaatatcgcgtcgctgttgttctggtccagccgcagctgcaccgcctgcaatgccgccttgcccggcaccggcgagttctggatagccagcaggtaacggtgcagtgccatcagtttctggtaaacgctttgcagggcactgcccttgtcgccgtgctcaaccagcaccccggtttccggcgcaaagtcccggctgatgcggtttaacagccggtaatccgactgcgccagcagcgcctgtttttccttgtcgctcagcccactcaccagctccggcggccgggtgttgtcactgaggatttgcagcgcgcgcttgatcggctgttcgccgctgatcacctgctcgatggcgctgatggcctgcggcagatcctcaaagtcccgcacttccagattgttcatcgccgcccgccaggtcgcggtataatccccgacatacagttcggtgatctcacgctggatattcccctgatcggtgtcgctgtacttattggttttcagcggcaggttcagcacccagctgtccatctcggtcagttcgaccagctccttgtcctgccggacaaagtaatccgtcaggccgtggcgggtcaggaactgcgggatcaccagccggctttcgttgccggcaataaacacgctgtcaaaactcggcccaatctggtcacgcaggttaaccggggcggacagggtatcctgggccttcaggcgcaggttctggtaaacccgctggttgatggtcagggcactcagctcctgctgggcctgcttcatcggcttaataaacggcgcaaagcgggcgagggcatcctgattgtccttgtcgcgctgccccttccagtcggtatgggccagagcgtaatccagatgggtcagcagctgcgcctgtaaatcccgctggccgtggaacgccttgctccagcgcgcccgcatgtactgcccgaccaagccgttgttacgcttgctgccgtcttccatcatgcgcatcacccgcaggatctcgagtttttcctcactgccggccggcgcccgattcaggtcgtccagcagcccctgcatcagcgacggcaggaaacgctgctccagcagtttcaggtaggtgccttccacatacggcccgaccccgtccccctgatacagcgccatgtcggtcaggaaggattttttctcgtggtagttgccgtaggccagagtggcatcccggatcgggttcagcagcggcagctggaggttgccgtaacggtcatccccgtccggcggcggcacggacaggaagtttttcgcctgcgccagcacttcttccccggcccggtagtttttctggtagaaataatgccagccgccccacatggccgcgatgactaaggcactgatcgtggcgaaggtgtacagctggcggcggttgcggctcagccagaggcggttttccgcggcgaggttcggctcagccagcagcacttcctcaaacagggactgggtaaaatacggcagggtatcgcccgccggccaggtcgggaacgcctgcgagccgaggtgatactgggctgaggcggactgggtgaacaagtcatccatctggccgacctgacgggcggaggtcaggtagacaccgcgcagcatcgggcggtggtgttcatcgttgtacaggatgtcttccagcatctgcgcgatatagctgtgcagcccctgcacctgccgggtaaagctgaacagagcgctgcgctggccggcatcgacgccgttgagcatcatgtccggcatcgccccgttgaggttggccatccactgctgccagaactgcgccagctcgctgtgccaggctttttcatcccggttattgaggctgaaagtcacgccgaggatctggtcacgctgccggcgatccagcgacgggtacatcgcttcgaagccgtgcagcaggtctattttggtcatgaccagatagagcggcagctggctgtggaaggtcagacggaggttttgcaggcgctggtggatttcccgcacgtagcgatcgcgttgctcccggttgtcggtcagcaggcgcagggtatcgacggtcagaataatgccgttaagcggctggcgctggcggttttccgtcagccagttcagcagggattcccacaggcggctgttgatctgcggtttgtcactgttgaccggcaccggctggtcaatcaggccgccatcgggatcgatgatgaccgctttctctcccagccagcagcgcagccgcagcgcaatgtcgccatcctgacgcaggtattccggcgccgcgatgtcggacagtttatagccttccttgatcagcgtggttttgccgctctgctggctgccgaccatcatgtaccacggacgctgatacaggtagttatagctgtccagatggcgttgtagctgggctttccagtgatcaaggtaacgagcctggtgctcgatatcgacccgcaccggatcaacccctttcagctcgacgtccaggttgagtttttccagctggcgcaggcgacgccacgctttgatgccgatccagagcagcaccatcaggatgatgagagcggtcgccagccagcgcgccgccagactgtccagcggggtatcgttgcgcagtttccattccggcccccacacccagaccgcgatcagcagcaggcaggggataagggccagagccagcgccatcgtggccttgagacgcggcagggatttaaattttgacagcgccggcaaggctgatttcaacggcgccaaggatgacaaagagggccatttcatgtgttaacgctcctgtgtgacgcagtatccttcgcaggcgaaggtattttttcagccagcagggtcagcaggctgggttcccattcagtgagtaacatgtgttgtcccgtgtgtaacaagttccggtaatgctggtgtgccagtgcggtcatgcccgcttcttcaagcagttgggcagtgaacaactgaccatagaattgatcccggggctccgtcagtgactgctggtgttcttccagcatctgaagggcggcttccagcccttgctgctggaagcagtgccagatggcttcctgatcggccgacgcggctcccgggcttccgctggtgtcgggttccggcgtgagccagtccagagtgtcaggagaaataaacggactcaggtcggaaaaacttaaggttttcagtacaggcagccgagccaaaaacgccttcagttcgtcacgcatggcctgcgcaacgcggctgtagccgcgttgttccgccgcttgggcggcaatggcatggccgtccagccagtaaggggcgagggctaagctctgctcaatttgcgccagcaatttgttatccgccgtcggcagtcgcgccagataatcggcggtacgatccgccgacgccggcgccagcggcgttttgcctgtggcgttcgccatcggcgccgtggtaatggtgtgccagaccgcatggcggcgcaggctatagccaatcggggattcgggataccgttcacacagcagatccgccaccgtcatcagggtttgtttccatgctttatcactggaactgttgaccgccacctcaggcatcggcgcctgttcaggagactgaggcgacggagctaccgacgccgcttcaggggtggtaggtgccgtctgtgtcggcgccgttcgtgcctctggctggcggttatagcgggtacgcagttgatcgacgtctttcgcaaggtcgggctcactggcgtgccagcactgagccagatgagccagagcgccttgtgcctcgtcgcgctggcttttactggcctgatcagtgaagctcgactgggccgattcaaaccgtttgatcacctgctgtgccagccggcgcttcaataccggtttgaccggccaggctttttcccagtagttttttacgtactctgtcagcagctctatcgccagaatcagctcggcagggtggccggcatgctgcaaagtccgcagcaggtgaaccatcagccggaagtccttgctgtgctcgctgaaaagttgcaaggcctgtcgctggagggcgtcaacttccagcgtgccatgtgacagcgagccgaatttgaccatctcgccgtcgatgaattcccaggcgggatcactctcactcagtgccttgcccgtctgttcgtcggacaggggcgccagcagggcgccgaaccagtcgaattgtgttctgatgtccatgtcggttaccaacggcaggcatcgcgtaagggtttcgcggcctgctccagctgagaaatattaaaggttatcgggctgccagtgcgagccgtgatggtcatctgatcgctgttcattaagcgcttgatttcctcaatgcccggcaagccgcggctggattcccataagtaaccgtgttcccgcaggaaccactcggttttgaattgggttttgtccgtagtcacagtgaccgtaccggatcccatcggtttaggcagcgccacctgcaaacgggtgatgcggtcaatgcaactcagcatcaggaccggacgaggaggcggaacccccaccgccggtgtggtcaggatcacgggtgcctcaccattttctccctgcgtcacaatgaagccagtagagtaatcggtgcgtttcatttcctgctccatcgcctgtcgccacacaagccccatgttttccatcgggatttgcagggcgttaaatttcaggttatttaccgtacggtcatagcacgccagccggacaagtggagacggttcaaaacggcatttttgcatttcgtccgtgtattcttctttgggtgcgaccacttcctttggctcaaccagattcgccagtttgggatcacccgtcaatgacgcgagcaatgagctgataattaatacaatattcataatctacacccgtatttagccagtttgtaaaccaacgtgcgcgtggcaatccccagactttgggcaatcagtcgggtgtcattgccatactgacgctgacgttgaaccaacacggcgctttcaaattcttcgatggcctttggcagattatcgatgtggctgtaatccacagaaatacggctcactcctgcgggtttcgatccactcagggaggcaagcagttcatccagttgtttttctttctgttgctgaacctgaaatacctgacggatttgacgtaactgcccacgcagttgctcgagttcctgcaactttttcaggcggtgctgcatgacatggcaatagaggccgaacatgttttcattattgataaaatggctgacatgttcggcaaaaatggcaatcacaccgcaggcctgtccgttacagtcaaacaggggaatggcatacaacccgcagttatgcggcagttccgcaacaaacgtgcggaaatgcacgtcgtcaatacgcgcgccgtgattcagggaatcccataccgtcggggttcccttgcgcagaacctgtatcagcgggttattgacgtcatcaatatctacattcagccggcgtgagctggcttggtggagttccggcaggttgtagcattccagcctgttttcattggtgttaagcaagaaaactaacagggcatcaaaacgcgagctctggcttaccagcagaaaatggtcaaccagttgttctatagtgtcatcatctaataacgctaacgcgcttttcagccgctgtttcattattctgcctcctcaacctcagcatggaactcatgttctgctacggttaagcgaatggcactgattgcggtgcctgcggccattttctgcaacagcagtaatgaaacaggcggtaatagtgcaccatcaatgatggattccagcatacgggcgccgttttccgcacgggtggcacgttgcaggatctcttccgatacgtcatcgctgatcgtgacttcggcgttaaagcgctgagacagcaggctatccagtcgagccagcttgctctgaatgatggttttcagcgtttcgtgacccaaaggcaggtaagggatcacttccatacgcgccagcaatgcgggtttgaaaaacgcggccagttcagggtagagcaggtcgttaagttgatctggctgctcggcatgatcaacgatagtttgataaccaaggttagaagtcaggaagaacacgacatttttacagtcgatgatacgcccttcgccatcggccagttcgcctttgtcgaaggcctgatagaacaggttcagtacatcaggatgcgctttttcgacttcatccagcagcacaacggagtacggtttctggcgaatggcttcggtcagtacaccaccttccccataacctacgtagcccgggggagagccaatcaggcgggaaacggtatgtttctcctgaaactcagacatgttgatggtggtgaggtattggcgccccccaaacatcagttcagcaatttgcagcacggtttcggttttaccaacaccacttggccccaccagcaggaatgcgcccagaggacgtcccggacgacgcaaatctgcacgagcggtcagcaggtgtttatgcaggttctggatcgcaacatcctgccctttgatgctttgtcccagatgggtaggcagttcggtcacgatagacagttcgctctgtgacaggcggttcaatggaacgcccgtccactcagcgataaccgaggcaatctgcgttttgtctacatggggagaaaccagcgtttgcttctgctgtaactctgtcagttgtgcgttgagcagagccagtttttcgatcagggattgctcatcagcggcggcttctggctcgtcttgcgcaatagcttcctgctctttcgcgtcttgagccgtctcttcaaccgcattttcgatggttttatccgtcgtttctgctgcaactgactcgtcgctatccgccaggagttggccgcgcaattcgatgatctgtgtcaccaactcttgctgttgccgccagtttttttccagcgtgacgagttcttcttggatctctacctgctggttttgcagttcttccagtctgtccgcatgttcattcagccccatccgctgttctcttttcagaacatcgatttccatttgcatctggtgcaattcagtcgtcagtgaggagatctgacgtggtggcgatgtcaggttaatggcgacacgggcacaggcggtatccagtacgtcaatcgctttgtccggcagttggcggccagagagataacggtcactcagtaccgcagaggctttcagtgcttcatcatcgatcagaacaccatgcgcctgttcgtaaatggcgcgcaaaccacgcatgatcacagtggcttcttccgcgcttggctcagagactttcactaattggaagcgacgagacagtgctgcgtccttttcgaagtattttttgtactcgctccatgtagtcgctgcgatggttttcagttcaccacgtgccaatgcaggtttcagcagattggaaatatccagtccgccagcctggttaccggcaccaatcagggtgtgcgcttcatcgataaacaggatgatcggcttagatgattgactaatttcagccatgatgcctttgaagcgtttttcaaactcacctttaaccgcagcccctgcctgcaatgcccccagatccagtgtcatcagttcactgtggcgcaatttatccggtacgcggtcattgatgatgcgcagcgccagaccttcaatcagggcacttttacccacccccgcttcacccacgacgatcgggttgtttttgcggcgacggcagagaatgtcgatcatcagatcgatttcgttatcacggcacagcacaggatcaagtttgccctgacgcgcctgttcagtcatattctgggtaaaacgcgccagcaggctgtcgctgtttgccggatggacgccctgcccatttttatcgtcgccgctgaaaggctgttcggcagagccattcgtccattcagtaaagttctgacgcagcaattcacggttgatacccgccagcatgcgcgcgggctgtggagtcagataacgcattggactgaacagcagagcaatcagcatgacgccaccgcgtaattcagtatgctgcatctccgtagaagccagcagccagctatcctgtaaccattccaccagcatcggtgagaagttcgggtaggtttgtacaatcgcctgatgatgaggcatcatctgatcgagttgttctttcagcagatctttatcgatgtctgccttattgaggatcaggcgcacatcactgagtggtgtgtcgatcatctgaaacaacagttgtgcaacagtaatttcaggctgctgttggctgacacaggatgccgccgccgcttccagtgcatggcgggtcatcgggtttaaacggtttacaagagtgggcagatcaatctgaatcatgacgacttcctatctcaataagttacttagctgctttaatatgtcttgggtctgatcaccgaggcggatggcatagaaactgtaaatggcagccagtaaacctacacttatccaaaacaggtgcttgatggtccaacgtctgctcagacgataacgctcatcacgctcgttgatatcgacatatagcgtggtcggcggagcttctccacgcagtgagtgaagctgttgctgcaagcgacggaacaggcgatcaaagtcatcgcttttctgggtgctgactttgtaacgtccgcgataacccagacagaggcagagataaatgaactccagcaggtgctggtagcgctgggtctcccccatcaggcgttcgagcaatacaaaaactttttcgcctccccaggtttcattatggaagtgaaccagcaacgattgcttcaaccagccattctgactgttccagccgtgccccaacgcggtttcatcaatgaaggtgcatagtacgtaacggaatgaaacaatcgcgccgggttcataacccttggtttgcagaaactgctcaatggctcgaatgtcagtaacaacctgttggtaaagcttatctggcagtgcctgatcactcatatcctgcaaacgcagaaccattcccagtaagggagtggccgcatcgatcatcgggttgaggctttcaccacgcaacggtagctgatactggcgctgaaacgttttcagcgtctcagacttttccagtgacggactgccaacattgatatcactcatgattattccttaccgcccctgatagcccagagctgcatatctaagtcagggaaatcccctgatacgtggaatgcgatggaattcccctgctggatctctttccatgccggactcttctgatccagacggaagtaggtgtatccagagtgatacggcagctgacgcggagccgcggataatgcaatcagtggcacacccggtaactgaacgctgaccagatcgcggattttctccatcgaggtgactttggtttgctgcacgaactgacgacgtaattgctcctgcggcgtacttgcactgatagccagtacaaattcggctttacgcagcagatcgttgtcgtggagcgttgccacgcggataccaccttcgttctgtttcaggacaattgacgttgcacgcggtgtcagaacaacgttcagtgcatcacgaatggcatgcatcgcgtcctggaaagtatccgtcagattattgtggtcatacgccagcacattccccggtaagcgactcgcatcggtgaaggttctcagctcaccgcaggtctggagcagttgggtatataaatgcagcgggtgcaggacagtctgttttgcgtaatggttgaacagaggttgcacgcggttcaacaattgaagcatcatgaactccgcaacatccgcaacgccctgctgacccggtgagccaatgcgtttggccagtgttcttgagcgttcagtcagcaggccgtcgatttccaccataaaacgtcttaacttgtcagcgacaaagatagacagacaggtcggaataaattcgctatccagaacgatagtgccatccttctgtttttctttgatacggcacagcgggatcgccgtgtaagcactcatatcttcggagccttgcatcagaaccggcgtcaattgcgcaaggttcagggcaaaggaatcgccacccttggtatgcaggtcacggacatcgctcggcagttcccgataacgtaccgcgctttgcatttccgcttccttgtcagcaatttcccgaatggtatcgctggacattggtaatgccagatagatgtctttgcttttcaggtcattgacgctttcgatgtccagcggttttggcagcagatcttggctgggtgcagagaatatcgtgccatcctgcatgatgccgctggcttcggtaatgccgatgcgccctaaattgagcagatcctgattgatgcttaaggagctgaaaccgtgaccataagcggccaacaccgatacgaggctatgagccagataatcattatgtttttgttgttgttgaaaatgttgtggcttgatgaacaatccttcgtgccaaatcacccgatttttgcctggcatgactactcctcctcttttctaagttcgacgtcgttatttctgacatgcaccaagatgttgtaatggcggccgatgtcttttactcggatgatctttttccattcagattgatttgcatctgcatagtgaacgatgacaccgatgtaacggttattcttttccaatatcagcgttgacaggggcttgtattgccccggtaatagtgtgtaatcctgatgatcgatataatttttccccagtgctttttcgagtttgtcgctttcaagctggtcataatcagcagccaaaaaacgagaatcttcactgagataaaccagattcatttcaacaggagccgcttcaccactttcattggggttgatattcggttcggccaataacgtaatgttggcaacagaagcctgttcatccggttttcctactggtgtggaaggatcccagatcacttgaccgactttctttgtcgcgttccatgcaccgctacagccattcagcaacatcgctgacaacaataaaatccctacagcccatacacgatgactagcggaacgtttcattgctggagtcctctaagccctgacgcagtgcgcggtcataagcctgctcatacacctcacggaatagcttttcgaacccctgctggcggctggaagctaattcacggtaatagttggtgtacatttcccacgcccaggccgcatctttatttctgacttcgttgctgcggcggtaatgtgagaagcgacggagcaattgatcaggggagaaagcttccagcatggtgtccaatgctgccgaaatggcttcccgattggcctgataatgcaattgcaggttatgcagactttccgagacggccgcaggtgcagacaagtgaaccgggcttttctgatccgagaacatcacctgcatggtggtgtcataatccatattcaggcgcagagggttatcttcgatggggcgtagttgtttatcacgcagtccatgctgttcacgctggagagccaataacccttcaatggcggctttcatggttttgcccatctcttgcagaaaatcattagcctgctggctgtcatgcagaggtaactgtgcatccagcccacgcatgagaggggtaatggcaacatgatcaacatccatatctgcgtactgccgctcggaagtgatacccggtaaatcaaggaactcctgatccataacactgcctcggttatcagaaatagggttagcaaatgggggtgattggaaatgatccggcggcaaaagctgctcagtatcatcagcttcaacctgctgcttcagcgtggtcaggctttcgctatcgagtaccctgagcgggtcatcgctgaaactatgctggatcgttggagcaatactgttatcgtcggcaaacacggctttttgtactactgcgccttccatcatggcatccagcgggttgctgtaactcgataccaaggattcaggtgataccgtcgaaggatcaacacgatctgcatcagaaaaactgatgtggatcttaatagacagattacccgccttaatctgatctccctgctgcaaacggatcagacttgactgaggcgttaatgcggcattgttgatctgcacaggttctgcgagtacttgcaggcagaatgcaccatcccgccactgcacggagaattgtgatggatgaatatttccctgctgatcctgaacagaccacaggtgactttcactgctaccgaccgtaccgccctgtgccgaaaacaggcaactggcggatctgccactttccagttgctcactgttgagaacccgcaatgaaagcgttggttgttgtttttccatagtcgttattccataactgaaattgtgacaaaaggtttcttttccggttcgccgagaaaactagtccaccccagatggttattctgctgcgcccccaataccatgccgctgacctgattttctgccagaccaagacgcaattcccatgcaaattgactgcgcatgacgaaagaaataaacatcaccaatggggcataattctttccatccggcaggaaagacaggaaccgatcacgagtcagattattgatgctgagaaggaacttcccgctgtaatcgccgacccatgaaccaatggtgaaattctgccccagcatggacagtttagagtcaccgattacctgtcctttcctttcgcttcccaagcggttctgctgatcaaggggaatagtgacctttctgaattgccagccgtgcagggtgacatcctgtaaatcaaaacagtgggaaaccaaactgcatatcacttccggcgagcggccggggcttgccagcagccctgcataggccagcattttgctgtgattaatgttcagcatccggcggttgacatcgctccccagacccacaagggaaaacatgcgctgagaaaaatgatcttctccccccttcttaaagcagacgtaatagcggtatttccgccagatctgatgcagaagcgtgattaagcgatggttaaacaggttgagaaaatccgtcagtcggttttcgttctgcgcttcttcccaagccagcgaatcgagatagtaacctggcatcggggactgactgccgtgtagccccataaaggagacttccagctcaaaataaccccgtctggtctgcgagagtgagatcacgtcacgagtcggaaatgccagactggcactggctctgaaacgaacagactcacgatcaggacgatcggtctctcccgttttttcccacgctaccgccagctgattgagcagctcaaccaactgataaaagttgtactgtgaaatgtccaatgccaagggtgtggcaggatcttgctcagtgattacatcaatgagtgttgacctatctgtaccggccattcataacactcctgattatctaaattgattaccttcaacatatgaaaagcgttgacgctggcatacagtgagaaaaaccgtgacaaaatcgtactgaacagataaagctcgccttctgagctgaatgcctgttgccggatatatagcgtggagcgcaagccgcgaacgggctgcccacgaaacaggcgatctgtcggctctgtctcgatcttttcaatggcatcaagccgtttctgcgatgaccgtttggactgtcggttatggatactcgggaaatcataggtacgcagtacctgcttcagcgcgtccttatccagcaatgacatatagttcagcgacatgtttgacagtagcgaccagtgcagaccgccatccagaagaggatagagtggcactgacgggcgcgtgatattgcggaatgtcgcaaatgtcgggctgccgatggatgggtaattaatgtcgccaacacgcagctgcaacggcaattcacggttagtacatgtcaaactgatagaaacattttcttttagtttgagtctgagcagatccgattcatctccccgtacaaatgagatgaaatgttccagcccccgacggaaaggcgattctttcacccgaaggcggtaataacgcattgagcgttcatcttcgtcatcaatctggtgattgaaactttcgaacggtgtatagacacgctcgccgatacgtgcccgactgcgttcaccattttcacccgccaaccagctttcaacgccatcgacggaaaaaatatcgtagttatcggggaggctataactggccttcaatggatattcagcctggctgccattgagttcaatagcttcactgtccatcggaaacaggttgatggctggtgtacagtgcagacggaaagtatcatgccgaatcttggcttctggtggtaatgcctgagaaaaatgtaaattcagtttgaaatctttggtcttaagatcttcaggtaatgttgggaaacccttcacatcaaaaaacaggaagctctccgcaaaacagaaatattcctgcaaaatgcgatatcccatgtaagcgtttttggggtacggcaacagggcatcttcccgttcaaaccctaccggcacaaaatcaaaatccggtagtgggattaccttatcgccaaccaccagttctgcttttctgaagtaataacagagccagaagtagagctgagaagtggtatagtcatcaccgctcaggtaaaaacgcagtttgtccagttccagttcatgcaggctcagttcagttttcgacgcaaaattcaggccgatgatgccttgctcattactgttattgacagaaatgtcttggatggagagagggaaaagccagacatcacgacacagcgtaaaagtacagcggccttgttcgtctcttttaccacccgatttttcgttcgaataaatatcatcatgagttgacagcgtgttactcataatctgcgtgccacgcttgaccggtgtcgctttcgtcacgacgctctcatcgggtgtgtactcgatgatagtcatactgggcgtcggacgcaggtaattaggccaaagcatattgagcaggccatgagtcagttcggggaattgatcatcaatctttgcccgtagattgccagtcaggaatgcaaaaccttcaagcaaacgctcaacgtcggggtcagaaccttgttcagacagaaatgcggcaagatgaggacgctcaactgcggcttctttccccagttgtcgcagataattcaactcatctctgaaatatttttcaaatgacatttattgagttcgctccaggcaatagcgccggttgttatccaactgaatgctgaattccacaatatcgttgatatcatccaacaagatttcagcgctgatgtgaaagctcaacagcaacggatctgaatcatcgttgatggcgctgacggaaaccgctgatattctgggttcataatttctgatgcactcttctatcgcccactcgatgctttgcttaaaatccaccgatgttgccgtcgcgtcattgagatcaataacacccagatcaatagcactctgacaggcaccaggacgagaattcagcacttccttcagatgcttctttatagaatcaagcagtgaacgcatccttgactgacgggaagagccggagcccttcccttgaatgcgctcgaacagactggcagagctgcccctgttccaactgtacagcgcagccataattattccttatccaaacgtccaaccagtgacagttcgaaacttgcacccatatatttaaagtgtgggcgaacttgcatagccacctgataccaacctggatcaccttcaacatccagtaccttgatttcagctgcacgcagcggacgacggctacgaacatcagttggcgggttttcctgatcagcaatgtactgtttcagccacatattcagttcacgctccagatcctgacgctctttccaagagccgatctgttcgcgctgcaatactttgatgtagtgagccagacggttgatgatgaacatgtatggaagctgcgtacccaacttgtagttggtttccgcaatcttaccttcacgggtattcgggaaaacttttggcttctgaactgagtttgcagagaagaatgcggcgttatcgctgcctttacgcatggtcagcgtaataaagccttcttctgccagttcaaattcacgacggtcagtgatcagaacctcagttgggattttagcctgcacctgacccattgcctcatacagatgcacaggcaaatcgctcaccgtaccgccgctctgtggaccgatgatgtttggacaccagcgatatttagcaaagctgtccgtcagacaactcgccatcagataagccgtgttaccccacaggaaatgctcgtggtcacgactgacattttcctgatagttgaagtttttgattggattttcaacgctggaataaggcagacgcaacaggaaacggggtgctgtcagacccagatagcgagaatcttcagattcgcgcagtgcacgccatttagtatgtgaagggccttcgaagacagacttcaaatctttgatggctggcaggtcggtaaaactgttaacaccaaagaactcaggtgaaacggaagaaaggaatggtgagtgagccattgcaccgacagcactgacgtattgcatcagtttgatgtcaggtgaggaattggtgaatgcatagttaccgatgacggcagcaacaggttcaccaccgaactgaccgtagcctgtagagtagacgtgtttgtagaaaccagactgaatgatttcaggcgaaaactcaaagtcttccagcatttcatctttagtagcatgaatgatgttgattttgatgttttcacggaaatcagtgcgatccaccagaattttcagtgaacgccatgaggattccagctcctgaaacggcttcgcgtgcatgatttcatccatctgctcactcagctttttatcaagctcaacgatcattttatcaacgacgagtttgttgatcggttcttcgttagcgcctgtgtccagaatactgctgataaacgcagcgataccttgttttgcgatatagtagccgtcattttctggtgtgattcttgcctgagacataatttcatcaagcagggaggtcgttgcgccagaagcaagagcggtgctgttttcttcgtgctgagccatttaaaaattcctttaaccagttattttttattgacgatttcaagttctttcaggagttgctcacgcacggattcatcatccagaagcgactgcaagcgagtacgaaatgcagggatatttcccagagggccttttagtgcaaccaatgcctcacgcagttccagaagtttatttaattcaggcactttttttgcgatattatccggtgaaaaatcactcagtgatttaatttccagattaacaggcatgtcttcttcatttttttcatcaagacgattagggacgttaaaagtcagattgatgttcgcctcattcattacggcattgaaattgttcttattgactgaaactgtttgccgttcttcaattggcgtatcttccttctttcctttcaaatcaccgacaaccagaagattcaacggtaattcgacttctgcggtctggtcacccgtattcggaacatacttaatattaattctttctttcggagctacgctacctggactattcttactcatattttaatcctttggctaatacaaccatgaactgtctaacaacccattattggtgagagaattattctaattttacccatataacaaatacaaaacatctccctaaaaaaaataggctaagaaaaacaatcgtatttgtcagtcacggatggattttatatcttcttatatataaacactcagaaatatcctatccaatcgtggaggtaacatcgatatgaaaaatcgtcaagcccgagtttgacattttatttttttgatgtaaagcctaaacataaattgataactccctctattccagcttttaatatccctatgtcaacctgtagtaaattataagcgtttttatcctcctgaaaatagataaatatttggttttacgctctgcatgagtatgcaggccaattacctatcaattgtataaaaggtaatatttttcatttttatgagaataaaatacaaccaatgaatcatgaatcataactactatcaataacaatatttattttatttagattaattattcggcattacagttcgaattaatcgaattttttgatccagttaacatttttcaaatgatcatgaaaaatatttcattaaaaaatgaaaaacatataaatattaattagttaaatttaattaaaaaatcaagatcatttattgaccagttaaataggtttgttttttataaaaactcagctataaatttcacaacggcaatgattataaaatttttatttgtcattgaattagagcttgccttgcaatttgcaaattactttgcattacacgatttcagctttattattcgctccgagtgttcggcggcgacagttttatttaattatagaatgaaactatcactcacggaatgagcacttacacttatacattggtaaaaatttataggatattcatatgccaactccatgttatatttccatcaatggaaaaactcagggcaatattactgctggtgcattcactgctgaatcagtaggtaatattttcgttcaaggtcacgaagacgaaatgctggttcaagaatttgaccacattgtcactgtcccaactgatccacagtcaggtcagccttctggccagcgtgcgcataaaccattccgcttcaccgttgcattgaacaaagccgttcctctgctttacaacgcactggcttctggcgaaatgttacctactgttgaattgaaatggtaccgtacttcaatcgaaggtaaacaagagcatttcttcacgaccaaacttgaagatgcaactattgttgacattgattgcaaaatgccacattgccaagatccatcaaaagcagaatttactcaattaattcgtgtgtctctttcttatcgtaagattaactgggaacacactacagcaggtacttctggttctgatgactggcgtgcgccaattgttgcttaatatcttattaattaagtattaagtaataaccattcagccaatgaatactattcattggctgaataaatgaataacttattatttcatccgtcaattcttatttttctttttcatatttgtttctttgattttctataaatgtcagatttttatatagtgattatttttatgctaaacagagatgcataaatacatgattacgtacgtaaccaatctgactgatgctatcttgttgatactgctttacgccagcacccacttttgcatgatgatttattgaacaatcgcaccaaaaccgcatataacattctgacctcaaatttttctaaaatccacgctgaattcattgaacacagtgatatgtcaacgccttcccataacatgcaatcaaagtgatataagtgaaatttttaaattaaaaatacaaagtaataaaaggactttgttgttttatcgctatcctactgaaatttcaattaagcacgaattgcatttgacttagtccttaaaaataatataggacataaccaaaacgattcataataaatcattaaggtaaatatataattacaaaccacaagattgggcaaaatatatacatcaatcggagaaaaataaaatattttctatgctttaatatttaattaacaaatcatacttaaacctaatctaacactgtacgttttcggatcaaccattgtcatttgggtattcccatgattaaaaagacggcaatttttatcttattatgtaccgcccttcaggtaaaagcgtcacctgaagaactcaatgtcatattaccgacagatgagacaagaaggactttacaagacagttcaagggaaatagaccagttaattgaacaacgccgtcaccaaggattagtcaatcgttccggtgccctttcgcctcagaccgtctctccagtattggtagaagcgccagtatgtctggatatccgcggcgtctatctccagggcattacgctgctgactctgactgatctgaatacactcagcacattgcctgacaactgtattaccagcaatgatatcaataaactgtcagcagaaattactaacctctatattgccaagggctatattacggcgcgggtgcaatttattcctcccagccatcatggggaattgggaattaatgttgtcgaaggttttattgaggccattgaaggtggtgatcgctggatcaatagccggatgctgtttcctcatctgacgaataagccactgaatcttagtcagcttgatcaagggctggatcaggcgaatcgtctgcaatcaaataaagcaacgctcgatattctgcccggtaaggtcaatggcggttcagtcatcaggctgagtaaccagcattccaccccgtggagaatatctacaataaccgataactacgggcaaaaaagcacaggtaaatggataagccgactgaatgccagcatggacagcccattggggttgtccgactttatcagtctcagcggcatcagtaccgtcgataaccccgacacccaatataatcgggcggcgactctgttctattcacttccatacggtgctgcgactttcagcggttttaccagctattcccgatatatcagccatccaaagctacagcataatgtgcacaaactgtatgggaattcacagcagtcgggtatgcgtatggattgggtattccaccgcaatcaatcacaaatctcgacattgaatacccagcttgtttacaagaatttcaacaactacttcgatagcgccaaactcagtcacagcagtcaaacattaaccgtgttttcactgggcataagccacttacaaatcattgcgaatggccttatcacttttgacgcaggcattgaacagggaacaccgtggttcagtgcgcaaacctcaaccgacaacttgaataagcaatttaccaaaggaaagttatccgtcaatttacagcagcgcttcagactatttgatatgtcctaccggctcaataaccaattttatacccagtacagcccaaacggactacccggtgttgagtggctcaatatcaccgaccgcaatgcagtacgaggattcagtaaaaatacgttatccggtgataacggctggtatctgagaaataccttatcccactcaataccgatactcaaaggttcgcttgacctgcgggcaggagtggacatcggacgggtcaaaggttatctcagtcagaatggctggcaaagtagtgccggattaagtactggcctgacatggcgctatcagcgtctgcttgccgatatcgaggtcagccgaggcaaattattatcccatcaaaatagagacaaggatgagtccatgcaattgttaacacgcgtttcttacaccttttaatttttgtagcaattagcattttttaaccgtagtcaacttggggttttattctcagggggctgcacatggcaatagaagaaagtaaacagaggtaataatatgcaagaaaaaaaattcaagttatctcctacgggaaaacttgccgtatccatggcaattattctgacaacctgttcagtcagttttgccaacggaatcacgcccggaggtgatgcaggacatcgccctgatgttaccctcgcggatacaggtgctacggtagtgaatatcgtagcaccttctgactcagggctgtcccataaccaatatgaggatttcaacgttaatcagatgggggcggtattaaataactcattgatcgatggctcatcagaattagccggccagttatcggccaacagcaatctgaatgggcaggccgccagtgtgattttaaatgaagtgatcagccgcaacccttcactcttgctcggtcaacaagaaattttcgggatagccgccgattatgtgctggcaaaccctaatggtattacctgcaacggctgcggttttatcaataccaatcaggcctctctggttgtcggtaatccgttagttgaaaatggcgttctgcaaggattcaatacttttaacaaccaaaatgcgctgagtatcaaaaacaatggcttgtcacatactgacgttctgaacttgattgctcccaaaattgatagtcatggtcgggaaatcaccgccaaaataatcaatatcacgacaggtaataaccagatttcagccgatggaaaaattctggcatcacaacaagcagatgttggtgtgctcgacagttattacctcggcagtatgcaggccggacgtattcgcctgctgaataccgcagaaggcagcggcgtcaatctgcaaggcaagatgacggccaatgacagtattgatattaagtcttacggggatgtgaatttgcaggccgctaatctgaaaggcggggatatcacattgcaaggcaacaatgttctgtcccaaggacgcctcaatcaatcctcatcagacaaagacggcagtgacaaccaccaaggcagtttcagtggtctttatgcccaacagaagcaaatcagtgaatccattgcccgtacccaattggaaggcaagaatattacgctggtggccaagcagaataaccgcgttatggcgaccgatattgtaggggataatgtcacgctgaccggtgctgatctaaaactggatggacagcaactccaccagcttaccagcaacaccaaaaatgaatggaaattatcctggcagtacgatgttactgaagaaagtgaaaaataccatcatgaaggcaataccatcaaggcgcatgaaaatgtccacctgacagccagcgaaggtaatgcagaagtgcttggcagtaaaatcagcgctggcaataaactgtccgtatccgcccggaaagatgtgaaactggcgggtctgctggaatcagaagtaacagccgagaaaggctataagaagaaccacactgttggtttgcagaccggaaactggaacaaaaaccatactgcccagagaagcatcggcagtgaattgagtgcagggggagatttaggcatcaatgcaggggcaaatgctgaaattatcggttctcaggtcaattccggcaaaaacctgattgtttctgccggtcagcaggcgaaaatcacggctcaatctcttgttgataatcaaagcattgctaagaataaaaaatactggggtggcattgcgggcggcagtaacaaagataacctcaataaagaagaaactcatcatatctctgatatcaacgcgaacggacatttgctgctgtcgggaatgaatggtgtcactattaccggcagtaaagtgagagcacaacagggagcttatgttgaagcaaatgatgggcaattaatcattgataacgtggttaacaactcctataagaaagtgaatgaaagaaccggtacgatatttaacatcaccaaaaattcgaaccaagaacacaatacacagcagaccacgtccaatagtcagctggtttccgataccgacctgaaattactcagtaataaagatatcaatatcattggtagtctggtgaaaagtgcgggtgagctgcaaatgaatacatcaggcaacatcaatgtgctggcttatggtgagcagaatagccatcatcaggaaaagaccgatctaaactggcaatattacgcccatgaagcagaagacaagcagtaccgtgtcggtatcggcctagagcacacgcgtgatggtcagaaaaccgatgtcacaacgcagcgtccatcagaattgaacggtggcaacctcaccctcaatgcaagcgaaaatgtcaccgtcaccggctccaaattagtgacgacacaaggggatgccaaagtcaccgggaacaatatcaatttactctctggggaaaacaggacatcaaccgaaaactcacaagtaaaaggccgtggcggtctgttcttgaccggtggtatggataggctcggtggtggtattgaaggtggttacgcaagtcatggccagtcccaaaaccaaaccacggctgtagtgtcaaagactcaagttaccggcaatcttgaattgaatgcaacaggagagttaaagcagcaaggcactcagcatcagatcaatggtgtttatcaggccaatgccgggagcatcaaaaatctggcgacagaaaatacggaatcaaactccactaatcagttgcaggtggacagtgaaatcagtggttcagccgattacagtgcaacgactcgtccggcagaaaaaacagccaaagcggccagtgagaagaaattggatacttccattgccaaaattggcttaccgaatgccggccttgagttagcggccaaaggcaacagccattataccggcaatagccagtcaaacgcagtcgtcacttcaatccaggcgggtaacgtcaaagtcaccactaacggtgatgtttacgatcaaggaacccaatatcaagccaatacaggagacgtgtcactgacagccggcagtcataccagtgaagccgcctacaatcgtaaagatagccattcttctgacaccactggcaacgcccgtctgcgcgtttacacctcaaccggcagtgatatttccgttaatggcaaaggtgatggcagttatcaggcaacctccaacagcagtgctaatgccgtgaccagcggggttcaggcacaaaacggtattgatatccaagtgaccagagacgcccgttaccaaggcacctccatgaatgctggcagtggcagtacaaacatcaatgcgaaagaaaatatccagtttgatcaagccactaaccgcaacgagcaaaaccgtacaggtcacaatggagagatttctctgaccgtgggaaccaacccggatggtaagaatttcagtgccagcgctggcggtggttataacactgaccagcagaccagcacgacggctcaaaccagtaccctcacagcgggacagggtgtaaacctgaatgcaggcaataatctggcactgaaaggttctgatgtctctggtaagcaagtcgatttaactgcacaacgtgggaaaattgaactgacttccgctcaggacaccatcaacaacaatggctggaatgttggtctcaagggcaaagggggtatgtccagcaaggcccgaaacaatgaaagcggggatagcgcaggaagtgtcaatgcggcaactgacaattccactggcagcagtgaggctggcaacaaaatcatcgataacaaatataacattggtggtgaagtgaaattcggtgtcaatcgtctggatacaatgacataccataacggccatgtgtccggcggtaacgtcacgctgaccagcggtggcgatacttcactcaaaggcaccaatgttactgccgatcgcgtgacaggtaatgtcggcggcaacctcaatgttgaaagccttaaagacagtacacatagcctgaatgtcggtctggatgctggtttgggttacagcaaaacagtcaaaggggacgataaagctacacttcctgtaccgaccgccaatagcagttcatcagaaacagcgcctgaaaccgcagcagcagatggtaaaaaagaggtgccgggactgaaagaccaactgaccgccgctttcaaaggttacagcggtaaactgaaaggcaattacgatacgctagacagagaagccactggtgagcaatccaccctgaccggtactcacggcgttaatctggatgttgcaggaaaaacctatttagtcggtggtaaaattgacagtgcacaagggacggtatcagtgaatacccagcagattgggcatcagcctgtgactggatacgataaggggagaaacctcggtgttaatctgccagattccatggtaggtcttgccggtgctgcacaaaaagatattttttccggaaaaattcctttcgtaaaaaatgagagccacgatacagcaactcctgctacccacagtgggatcaaaggccatcaattagattaatcagcatttattcgattgttcctcagtacggtagcccatcatgcggctaccgtatttgttgccttttctgttttgcctgttactctttttccacatacccatttagcgcatagcgctaacataatgagtacactaggcaaaaccagaattaagggaatgtaatgccaagagattttgttccatttattgcccatttgattcgggctgcccagcgcttcaatgatcggatgggaagccagttcggtgccgccattacttatttttcatttctatctctcatcccaatcttgatgctctcttttgccatcgccggttttgtactggcatccaatcctgatttgctgacaaggttgatcaatggtattgctaacagcatcagtgacccatcgctggctaacacgctgaaaaacagtgttgatactgcggtgaatcaaagaacgacggttggattgacgggtctggcaatcgcactctattcaggtgtgaactgggtaggcaacttacgcgaagccatcctcgcccaatcccgcgatgtctgggaacgtcatcatgcagaaaaagaaaaaatctactctcagtatatccgcgattttttctccctatttggtctgctgttcgcattggtgataacgctttctctgacctctatcgccggatctgctcaggcaaccctcgttcatgcctttggattagaaggtattgaatggctgcgccctgcatggacactgataggcatgaccatttccatttctgccaattatttgttatttctgtggatattgtggatcttaccccggcatcaacctgagcggaaagcgctgtttcagggcaccttaatggccgcaattgggtttgagatcattaaatatattatgacgatcatgttgccaaaacttgccagttcaccttctggcgccgccttcggctcggtcattggcttgatggcatttttctatttctttgcccgtctgacactgttttgtgctgcttggattgccacggcagagaaaacatcataacaaaccaaaaaaaggagtcatgtatgccatttgtaaacatcagaatcacccgcgaaggtgcgactgccgagcagaagaagcaattgattgaaggtgcaacccagctgctggtggatgtactgggtaaaaatccggcgacgacgtttgtcattattgatgaagttgaaacggataactggggcattggcggtaaaagtgtaactgaagtcagggctgctgcgaaaaagtagccgacaattgacggatagtatatcgatgtaaagggcgaatttgctcgccctttttgggaaaatttactcatttggtactgcatcatgtttaaaccacaatcgaggtttcatgaaggtaacgccataacgcatttccctctttaaattcaatgatgacaacagaccaacgtgattggtttatgccattcatgcaatgtgtttccctgtattggcataccaccgtatcgccagtattaaccagtgtcttaatagaatcgatttcaatctttaaactgggtttatagcctatattctgatgaaacagctcactgacctgaacaaaaaaagcaatatgcccacgggttgtaatcatgctgaattcagggctgaagcaagaaagcagtttttccagagacacagcgcctttttgctgatcattggtaaatacgtcttctatccattggtgaagttccatgatgctttgatgcgcaattaactctttttggttgttcatacagtctcccgactcttagccagttggcgcaattttaacaggggcaataaacctgaaattgccgcaataataaaggtgagatggtaagccgttgccggagtagtttgatgctgcaatacattaaaaatcatggcaaaaatagtggcgccaatactaaaacatatctggcgattgagattccagatcgtgctggcacgggataaattctcgccttcaaaatccagcatcgccgtggtttgcgcggtatttgcgcctatccccccaccgattcccatcaaaaggtatgccataatcagaagaggctgatcctgaggggtatttacagtaacgagtatggcaattcctgcggcatgtaagacgagaccggcaaagaacaaacgtaccgatcccaactggttatatattcggccacagattaatatcgcacagaaggaaccggctgcataaaaaagcatcagcaatccggctttctccgcagaccaattcagttcttgttgcagatagaagatattgagcaggttcactccggtaaatacaccgggtacagcgtaatagacccatattgaaaaacgcatccggatgttggtcagaatgtttaaatcgagtaccggattattgatgcggcggtaatggcgaacataaagtaaagcaaacaagactcctgtgataaccaatatgtaaggcactaatttagtgcttgcttcagcatagagcgacaaaccgagtaaaagagaagccagcgacaaacttaccaaaaatagaccactcaaatcaggtttaggagccgttgttttttccgttttaatccaaagaaatgacaacagagctgcgataagactaaaaggaatattgctgaaaaacacccaatgccaagagaaatgatctacgattatcccccccactcccggagagactgctggggcgattaatgcgaccgccatgataatcgttgaaatctttgctctttcctgttttttaaacaggctcaaagtcagagcctgtccaacaggaatcaacaaccctccaccgagaccttgtataaaacggaatagtgccaggctgaaaaaatgcgtcgccatacccgcaaagaacgcggctattgagaaaaccaacatggatgcagtcatgatttggcgggtaccaaaccgacttgccaaccagttactgataggaataatgagagtcaatcccaataggtaactattcgcaacccaggtcactgttgattccgaaactgataaattacgtgcgatatccggtaaagctatagctgacataaaaatgttgatacagtctataaaaaaaccaaccagaaaaattattgcaatacgataacgataagtcattatgccctccactgcggagtttaggctttcttgacccgttaagactatgaatataaattgaacattccgtttagctgtaattaaccatgatgaataaccaattaaaccggattcaaacctttattgctgtagtggattgtggatcattcacacgggcagcagaacgactgttgatcagcaaagcaatgaccagcattcacgttaagcggctggaagagtcattaaacataccgttattgattcgtaattccagaggagttgcgctgacggaagcaggtcagtttctttacaatgaatttagtgaaatttttattaatattcagtccagcttagataatgtggctgaacagtatctttcactttctggcaccctacatatcacatcaacaatcgagttcggtgatcggtttctccttcctctgattggcgagttctgtaagatacatccgcaacttaatgtcagctatgacgctggctctgctcttaatgaccttatttcagacaggctggatttagccatcaggttgggggtattgcgagattcttcgcttaaaagtcgtaaaattgctgactttaaaatttatatggtggcatcacctgactggcttgaaaaaaataaactggaaacagtcaatgatctcaaggatgttgattggattgctaacagtaatttgcaaacacctacacactgggaattaagtcactccaccttaccgtcaattgatatacgagccaaagccagattcaacgccaactcttcgacctcaataaaaacaatggctattgcggggttcggtgtgactgtcttacccgaatggatgatagaaaccgagctgcaatcaggcaatctagtgcgactttttcctgaatattcactgccaaaacagcccgtcacaatcgtatacccaaatggacaccagattcagcgtaaatgccgagtgtttattgattacctgatagataaactcaagttatgatgtttagctatctcgccgtaaaccgcatcacaaggtcaaataataaccagattattatcaaacctaaagctactccgccccttttttgatatcagcatcttgcttggtatcaatggctggtgtttccggcacgggacccggccgcataatctggttaaaaccgtttctgagctgattcacattaacggccgtttcatcttttggctgcaccagaataaaggagatgtcctgagacaacatctctttcagttttttgttcaaaagcggtggtgtcagagaagataaaaacgtctgccttaagcgttgaaattgctccggtgcaatatcgaccacattattctgctgtgaaatcaggcgctggttaatcaatagatcagtatttgtgcgggcatagaccgcaaagagctgttgcagttgaagccgtttttgagcatacagttcatcaaattgctcttgtggcaggccattctcacgcaatgatgccagctcagaagccagataaagtgtagattctgtcagcttgtccgaagaagtatccatattcaagaagcaatttgcccgctggtacaatatgcgacaatccagatctaacttcatgtcagcctgcttttcttcccgccccaattgcaggtagcgataaagcgcttcacgagccaaatcgtttaaccaatactgaagcagggtctgcgaatcgttaatcggttgccagttcaggttccagactaaagacagccgatcttgttgagctttatcactgactacgccaagcgtttctgatttcagcggcaacaacgtcgcaacggctaccggtgtctgccgttttccttttaatggcgaaaacacctgattaatgcgctctgacagtacccggctgtcaacatgaccagcaacatacagcgtcatcgcatctggcgtgtaccattgccgataaaatgcttcaatttttttgacatctacaggcattgatacgctcgcacccggatcatgatcgagcaatgtcgagccttgcagccgcatccgccacacaggatcttgtatatctgcgggtaaagtcgcgacggaatgatcggtcgctttcatcgcctgtgccaaggtttctggcgtaaaaaccgcaccacccgcaatatccgacagccataccagtgcatctttcagtaaatcagggcggttatttggcaggctgaggctataaagcgtgaaatcatatgaaacaatggcaggaggaaggggatttttgctatcaatcgcgttgcgccatagattttccagtttttgcgatgacaaatctttgctgctgaacaatacgacttttggaataaggtaggtgtagccgtgttgttgcgttttctctgccagtgaaccggttttcacgattaaacgcagttgtatcctgtcattgggacgctgtggagtttgcagggcttgccaactgaatccattttcaagtttaccttgttgccaagccggatcaggctgcaaaatctctgcctgtgctaaataagacgtagccagaatggcgccaccaataagatacccgattttcttgccctgcattctcacttacccctacctatttagttttatccttgttatccctggcttcacctgccacagtttaactattcatgccaaaccattaatgcccactactaatcaacaaggcttcattttaatcgcagtttctgcttatcaatctgacgattatagcctttaaccagtaaccccaattcatcatcctgatggtttttgggacaaagtatgggcgcagtcggctgttcttcattcagagcacgcgcaacatcgcgtagtggatggatgataatgcgattcacgcaccaacttatcgccaccgtaagaataagtgcgagtagtaaataggtggtcaacattaatgcaagtgtattcaaggcaaatcggtatactcggttagaatcgacctgcaagatcaggtatccctgtgacgcttcggtttgcggggtaataccatagatatgcaaagggatctgtacctcaacgggaataccaaaaatctgctttgccaattcgggtatagggcgataagtcgcgaaatccaagctcatcacccgggcattattcggtgataccacatcagcccgccccagaatgcctgatgtctttaacccaatcaacagcgttttcgctttattgaggtctgaattcagcagcgcttctgccagaggaacttgaacctgtgcagccgcattattgagctggctgatataatcatctttccgctgctgtaacaggtgtgataactggatagtaatgaaaatggcaatagttatcaaagcgactcctgtcactgcggccatttgtttaatagttaatgaacgtttgacacgcaatttcatcttatccaaactaatacctgcaaaaaatacgagctatcacaccttaataatgtgactgagtatacttgatttttctggcggtcgtcttattttgatgagttcaaaacagaagaatgaccgcaacataacgtttatgtttaataacgtttgcattatccatatcatatccacgttatatcacggtcaaagacgattatctggatgaattttcgtcctgttcaattgcaaaacaggcgaccagttgctcgtcatatttccttagcttaggctggaattgcgtacagtgaccaaatgcgcgacggcaacgggcggcaaaggcgcaacccggaggcggattcatcgggcttggcaattcccctgtcagcttgatgcgctcacgacgcagtgccggattcagacgaggtgtcgcagacagcaacgcctgtgtataagggtgacgaggattattgaaaatctggtccttactgcctttttcaacacaacgccccaaatacatcaccatgacttcatcagcgatatgttcaaccaccgagagatcatgagaaataaacacgtaagacaaccccagatcctgctgtaaatccatcatcaggttcaagacctgcgcccgcaccgaaacatccagcgcagaaaccggttcatcggcaatcaacacatccggatttaacatcaatccacgggcgatggcaatgcgctgacgctggccaccggagaacatgtgcggataacgctgataatattccggttttaatcccactttttccatcatcttcaacacttgttccttgcgttccgctgcggcgagcgacgtgttgatcagcaacggctcttccagtatctgacccacttttttgcgcggattcaaagaggcataagggttttggaagacgatctggattttctggcgccgcaatttttctgcttgtttatctggcaccaataaatcctgtccctgataataaagctcaccctccgtcggtttttcaatcatggtcagcaggcggccaagtgtggatttgccacagccagattcccctaccaccgccagcgtcttgcctttttccagctcgaatgaaacaccatccagcgctttaaccatgcgctcaggcgcaaacatccctgtcttcaccggataatatttctttaactcggtggctttgagtaaaggggcagtggccttttcctgttcgcgcctgttttgattacgaatgttttgctcactcatactgtcggtctcccctcatcatccagcggcatatgacatttaacctgactttccccaactgttttcaatgctggctctacctgacggcaatgttcattcgcataggggcaacggggattgagcagacaccctgtcgggcggtcatatttgcccggaaccacaccgggcaacgacgccagacgggatttatccgtcgaaaattccggcaacgcccgtaataatgcctgtgtgtaaggatgacggggcgcacggaagatttcagttgccttgcccgcttccactacctgcccgccatacatcacgatgatatgatgagccgcttccgccactaacgctaagtcatgcgtgatcaagaccagcgccatgttttcctgctgttgcaactccagcagcaattcgatgatttgtgcctgaatagttacatccagtgccgtcgtaggttcatcggcaatcagcagcttaggacgacaggcaatcgccatagcaatcatgacgcgctggctcatcccaccagacaattggtgtggatagacatccagacgggaagccggatcaggaatacccaccagcgtcaacaaatcaaccgcccgctggtaacgggttttgcgactccccccctgatgtactttaagcgcttctataatctgaaatcccacggtatagcacggatttaagctggtcatcggatcttggaagatcatagccacttccgcaccgaccaactggcgacgctctttctcagaaatttttgtcagatcacggccattgaattccagtttttctgccatgaccctgcccggataatcaaccaaccccataattgccagtgaactgacggacttacctgagccggattctccaacaaccccgacaacctgtccctgctccacactgtagctgatacggtcaacggcgcggaatggcgcattttcttcaccgaagtgcaccgataattgatctacattcaacaatgccatttcaatacccctactgcttgagcttaggatcgagtgcgtcacgcagcccatcccccatcaggttaaatgccaatacggtcagcaggatagccagccccgggaaggtcacgacccaccacgcgctctgggcaaactgcaagacatcggccagcatggttccccattctggtgtgggtggctgcgcccccatgcccaaaaaccccaaggcggccatgtcgagaatggcatttgaaaaacctaatgatgcctgcacaatcaagggagcaagacagtttggcaggatattgatgaacatctgacgtatggctcctgcacccgccacttgtgaagccattacataatctcggttcacttcaaccagtaccgccgcccttgtcagacgaatatagtgaggcaaggcgacgaaagtcagcgccagtgaagcattgacaatcgacggaccaaaaatagcaaccagtaccaatgccaatagtaagcttggcaatgccagcatgatatcgacaatacgcatgatgatcgtatcgacaaggccgccgaaataaccggccaatacccccaatatgatgcccatcaccagcgacatcaccacaaccaggcagccaaccagcaaagagaggcgtgcgccatacatcagacgggataaaatgtcgcgccccacatcgtcagtaccgaggataaactgccagcttcctccgtcctgccatatcggtggaactaacagagagtcacggaactgctctgccgggccgtggggtgccaacacattcgccaatagcgccactagcagcatcaggacaatataggcaaaaccaacgaccgcacccttgttacgcttaaaataatgccagaactcctgtatcggcgtcatcaatttcggcgcaccggataccgctggctcagtagtttgagtcatcacgtgctccttatttcttatgacggatacgtgggttgacgacgccatacagcaaatcaaccacaaggttgaccagaataatcatggtcgccactagcaatactcccccctgcaccaccggataatcacgacgctgaagggcatcgatcaaccagcgtcccagccccggccatgaaaaaatggtttctgtcagaatggcacctgccagcataatccccacttgcaggccgatgacagtgacgactggcagcaaggcattacgcagagcatggataataatgacacgcatacggctcaagccttttgcgcgggcggtacggatatagtcttcccccaacacttccaacatcgcggaacgggtcatgcgcacaatcacagccagtgggatcgtccccagcacaaccgcaggcaggagcatatgcatcacagcatcaataaagtcgccctcttcgccccagaacagagtatcaatcagcatgaatcccgtcagcgggtaactatcatcaagaaatacgctgtcgcttatccggccggaaacaggagttaaattccattgaacggataccaacataatgagcatgatcccccaccagaaaatcggcatggaatagcccgtcagtgataccccgacagccgtatgatcaaaaacagatccacgcttgaccgctgccagtacgccgaccggaataccaacagagatcgcaagtaacatggcgcagacccctaactctaatgtcgctttgaatcggggcacaaactcgtcccacacaggaatgcggctttttagagaaatgcccaaatcaccatgaaatatgccattaatataatgaaaatattgctcccagagaggtttatccaaccccatagcagccatcaattcggcatgacgctcagcagaaacaccgcgttctcccgccataatcagcaccggatcgccggggatcatgtgtacaaaagcgaaagttagcagtgtaataccaataaacgtaggaattaccattcccaaacgtcggaggataaattgcagcatatcctgggttctctttttaattaccagttacagctctcaggctgtttggtgtaatacaagggtcaacttgcctgtcagagaagcgaaaccatccccacagaacaatctgggggatggttaatcacaacaaatcaagagcaggattagtcgagagtcacgttgtaaaagaggtgcctaccaagcggatcaaccaaatagcctttcacttccttacggattggttcataaaccgtggagtgggcaacgatcaatgcgggtacttgctcatgcattacaacctgtgcctgtttgtaaagcgctgtacgtttggcattgtcagccgtttcacgggctggcttgataacgtcctcaaatggcttgtaacaccatttcgaatagttagagcctttctctttggccgcacagctaaacagagtgccgaagaagttatcgggatcaccattatcccccgtccatcccatcatcaccgtctgcggttcaccatctttagcgcgtttcagatattctccccactcataactgacgatcttggctttgatgccaattttcgcccagtcagcctgaatcatttcggccatacgacgggcattcgggttatacggacgctgtactggcattgcccacaaatccgtttcaaaaccattcgggaagccggcttctttcagcagttccttcgctttagcgggatcataggcataatctttgatgtcatcgtcatagctccacatggtcggtgggatcaggtttttcgctttttgcccagcgccctgatagaccgcatcgatgatggcatctttgttcaccgccatcgccagcgcctgacgaaccttaaggttatccatcggttttttatcgacattgaaagagagataacccacgttcatgccagcctgctccttcagaacaatatttttgtcctgcttcatacgggaaatgtcggcagggtttggatacggcatgacctgacattcgtttttctgcaatttggcataacgtacagaggcatcaggcgtaatggagaacaccaggcgatcaattttcgccgggccttcccagtaatccttgaatgctttataaagaatgcgggagtctttctgatattgctgcaattggaacgggcctgtgccaatcggatctaagtcaactttctccggtgttcccgccttcatcatcacatcagcgtactctttggacagaaccgaggcaaaatccatcgcaaggtcggcaaggaaaggcgcttcagggcgggataacacaaaacggatggtgtaatcatcaactttttctattttgctgatgatgttatccagatccatgccaataaaatattcgtagctgccacctgaaactttgtggtacggatgatttttatctttctggcgcataaaagtaaaaatcacatcatcagcgttgaaatcgcgagttggcttgaattccttagtgctatgccatttcacgcccttgcgcaaatagaaagtataggctttgccatcatcactcacatcccagcgttcagccaaactgggaatgacatttgtcgtacctgccttgaaatccaccaagcggttgtagatctgtctggaagttgcatcataagttgtgccggaagtgaataactgtggattaaaaccttctggagaaccctcagagcaataaaccagtgtctttgcctgaacacttgctgttactgctaacgcaacgaggccaatgcccagtttcagtaaactgaactttttcttactggaggttgccattacttaaactccgtttgtgatgtttatcgtgtcttggccaagtccagcgtttccacctaaatgatgccgtcccgacccgcgttattgttgttcgtttatcaattaaccaattgttatgcttgacgtcaacataatcacatataacactggcaacattaaaaaaacataaaataaaaaaataattaacacttgcgatgtaaaaatatgacagtcggcatatttaacagataaaaccactgaaaatatcggatatataaagaattaatttctattggcgataatttgaaatttgtgactgaatacttaaaaaatgaacaatctgccttatgaaaaagacgggacaatataagatgcgggtacggatagaaaagaagaaatgttttaaatttaaccaattaatataaaaataatcgtgttattcattaaagaaacactttattgagtaaatttaatttatgaacaaggagaaagataatgaattatcgaatcagggaaattcagttcctgagcgaattaccgacagtttcagagatgaaatccagatagatgaacaattttatcaaaccgaccgtgatataacgtcgatgtttaaaatagggatcaaggaatgagttaacgccgagtttttatttagcacatacgaaaaaaccccgctcaaagagcggggtttctgaatgctggtcggcgagagaggattcgaacctccgacccactggtcccaaaccagttgcgctaccaagctgcgctactcgccgaaaacgaagcgcatcttactgccagcgccgtaaaccgtcaattctttgga

SEQ ID NO: 14984 - DNA, 278026 bp, Xenorhabdus bovienii
  unsure (1)..(278026): unsure at all n locations
  Genomic contig Name=Xb4151_4152.C443
tctttttttcctcaaaacgctgtaacaaccagcaaaaaggctatttttgaggcactttttcacatgatatttgcagaaacctcccagaaaagagatcgacctgctcccaatcagtgtattcaatctcttttgttgtatcagtttctccacctgtcatccgcataataaactgaatcatgatgcgatccagccaacgatagcggggataaagcaacgcgccagcaaagacatcacataaatttggcttccaagggctcttcatcaagaacttgcgtaaataagcattggtttctggtgtcctcttttctagttttcttgccgttaggttgaccccgaagaacgccgtcggcatttgattcaattgtttttggtgccgaatagcgaacttatgtaatacggaattaaaatggccatagcgtatcgacgcccctatcatcaccttatgataaggtttcaaattaatgtgctttattgtcgccagatctcttaagtcacactcagcccccgcgcgacggagattttcagcgatataagtaataattttcttagtctgtccatcctgagtggaataaagcagtaagcaattcataaatatacctttttaaacaaagactgatcttcacagttattcacgccaaaaagtcggtgtgaacagaactaatagagtgaaaacttccaaacgtccaaacagcatggttacgaccaatatccatttagccgccggattcatggtggtaaagttatcagagacggctcccaaccctggccccaagttattcaatgttgcggctatggcagaaaaagcggaaaactcatcaacgcctgttgcaatcagtaacagcatgctaataagaaaaaccaacacataagcagagaagaaaccccacactgcttcaataattcgttccggcaatgctctttgtcccaatttaatggtgtatacggcgttcgggtgaaccagacgttttagttcacgggagccttgcaggaacaacaacaagatacggataacttttaatcccccacccgtcgatcccgcacatcctccgataaatgcagaacataagagaagaaaaggcagaaatagaggccaatcggcaaaactgactgttgtaaatccagccgtggttgccatcgaaaccacttgaaagaaagcatgattcagtgcatctaatcctgattcgtaaatggattgttgccacaatatcagcacacagatcaccaataatgccaattggatagtaatgaacatgcggaattccggatcacgccagtaaactttcaaacttcgtccagaaagtacggcgaaatgcaaaccaaaattacagccagagatcagcaggaaaatcgcaataatggtattaatagccgggctattgaaaaaaccgatgctggcatcatgtgtcgaaaacccaccaatcgcgattgtagaaaaactatgggaaatcgcatcgaatatcgacatacccgccgcccataacgctattgcacaggcaatggtcagcaagacgtagatcagccagagtgtttttgcggtctccgcaatgcgggggcgcattttattgtctttcaatggccccggcatttctgcccgatacagctgcattcccccgacaccgagcaagggcagaatcgctacagctaatacgatgatccccattcccccaagccattgcagcatttgtcgatagaagaggatagctttcggcagagaatcgagaccaataagtgtagttgcccctgttgtcgtcaagcctgaaaatgattcaaaaaaggcatcagtcactgaaaggttaggtttctctgagaaaatgaaaggtaatgcaccgacacttcccagaactgtccagaacaagacaacgatcaaaaaaccctctttcggtttaaggtcatgcttttggttccgattaggcacccataacattaaaccaatcacgagagcaaagataaatgtctgactgaatgccctacccgcgccatctcgataaatcaatgccaccaatcccggaataatcattgtgacagagaaaagaatgacaagtagcccgacaatacgggttatggcgcgaaaatgcattcggctggttcctcaaaaatccggtaggacaaaataattatgattttggtgttaaaaacagagcaccacggcttaagtcacgtaatttatcacctatctcccccgcaagggtagctggcagtgaaacttgcaatgtaacgttttcagcatattcactagcaatcacttgccctgagaatttttgtagcaattgttctaccatcgagatataggcatattcacactgcaattgatacagtttctgcggtactttgtattctgtttccagtaatttcagtgcctgctgcacaccattgccataggctttaaccaatcctcccgtgccaagtttgataccaccaaaatagcgaactgacacggcagtgatttctcccatcccgcttcctattaattgcgcgatcatgggcttaccagcagttcctgtcggctctccatcatctgaaaaacctaattgctgggaatcatccggcgcacctgctacaaaagcccagcaatgatgtcgggcatccgggtattgctccttgatgctctggataaataactttgcctcattcaccccgctggtgtgttccagcagagtgatgaaacgacttttctttatttcttcagtgaaattgactgaagccgcagggatcaaataaggcttcattacgacaactgtaaatctctggtcatattttcaatttttccgtcgtgaataacgatgttatcttcaatgcgaataccaccataaagcttaaacatgtcgatttttttccaatcgaaatgtttgctgtattcattttcacgccacggtgccaataacgtttcaatgaaataaatacccggttcaatggtcaaaaccatcctcggctccaaaatacgtgtgcaacgcagataaggatgtaatgtcggcgcggccagatgggttccggtatcatcctgcatgaatccagcagcgtcatgcacctgcagacccagtgaatggccaagtccatgtgggaaaaatggcgttgtcagccctttctcaaccatagtttcttcagtgattccattaatgatcccgtgtttttttagcaacttggctatgcgacgatgcatattgatatgataatcagtataccgaatacccgccttgatcgagccaataatcgcttgttgttccccatttaaatctttaatcagtgaagcgaaatcgttgttatgttttgctgcataagttctggtgatatcagcaacatagccattatattctgcaccagcatcaatcaaaaaactgcgaatttcggaaggtaacgtctgttgtaatttggtgtaatgcaaaacggccgcattttcattcagggcaataatattattataagggacatctgtatcgcggtgccctgttgccatcaaatagaacatattgatttcgaattcgctcacaccagatgtaaatgcgtcgtatgcggccagatgaccatttacggcagttttctgcgcttcacgcatacagaccagctcgtaatctgttttatatgagcgatggtaactcaaataatccaagaccattttgggattgatattgtgttcgagaatacccaagttctttgcacgctcagtctgctcaccaatataagctgtattctgttttgataagccactcaattctgctttgatatcatcggcttttgccagatggattaactcaacttcttcagtccagtggctattgggcaaagcctccacgctatgccaataatctacgggtgaataaaaccagagtttaggtttattaacaccatcaacccatagccagcaattgggtactttagtcacaggcacccaagccttgaagtgtgcatttaccttgaaaggataatcgcagtcatccagaaaaacacgtaatgactcgccagagtgaataagtagagcgtcaagctgatttcgtgccagtatttcgcgggcacgtctttgtaagattttaatatgttcgtggtacagagatgccaacttttccatttttataaaccttttgattatctggcaggagtataaatcttaccacaattcattatttttagtgtcaccatggggaaatctcaccttagtgcggttgactgacaatatttatatttttcataactataataaaaaatattgtcatccatcataaatcttacctgtgatccgctctacaaaaaattcatcattggtttgcattcgattaacacactaatcacaatcaaccgtatctggtcataccagatggtatgcactcattgaggagattgacatgctctacctaagtgacactattcaagtaaactggctgaaagatggcattgcagaactgatattcaatgcaccagctgcaattaataaattagatacaaagaccgttgcttcattggataaagctgttgccgtccttgagcaacaaactaaattaaaagggctgttgctacgttctgaaaaacaagcctttattgttggtgcagacatcacagaattcttatcattattcgatgcaccaaaagaaaaacttcaggaatggctgaagttcgccaatgatattttcagccgtattgaagatctccctgttcctactatttctgcgatcaacggctatgcacttggcgggggttgtgaggtagtgctgtcaactgactttcgtgttgcatccccagatcttcgcatcggattacccgaaactaaattaggcattatcccgggctttggtggctctgttcgcctgccacgtttaattggcccagataacgctctagaaattatcaccgcaggtaaagatattggtgctgaagaagcgttgaaaaatggtctgattgacgccgttgtgccgactgaaaagctggtagatgctgctgtttctattctggaactggccatcaaaggcgatctggattggcaagctgcccgccaacctaaactttccccactgaacctcaatgatgttgaacgcaccatgagcttcaccgtggcgaaaggaatggtgatgaaagtcgcaggtccacattatccagcgccaattactgctgtaaaaactattgaaaaagcagcgacattgggtcgcgatgaagccttgaaactagaagcagaaagttttgttccactggctcataccactgttgcccgtgccttggtcggcatcttcctgaatgaccaatatgtcaaaggtctggcgaaaaagcatctgaaagaagtcacagtgccacaacatgcaacgatactgggtgcaggtattatgggtggtggtatcgcctatcaatctgcacgcaaaggcgttcctgttctgatgaaagacattaatcagaaagcgctggatttaggtgtcaatgaagccgctaagttattgcataagcaatttgagcgtggacgtctggatgctatgaaaatggctaagattctgtcatccattcagccaacactcagttatgcgggcattgagcaatctcagattgttgtcgaagccgttgttgagaacccgaagatcaaagctgcggtcttggcagaaacggaatcacatatcaacgatgattgcattctagcctccaatacctccacgatcccaatcactgaattggcaaaatcattgaaacgtccggaaaatttctgtggtatgcattttttcaatccagttcaccgtatgccgctggttgaaatcatccgtggagaaaaaacctcagacaagaccatttctactgttgtggcttacgccagcaaaatgggaaaaacaccgattgttgtcaatgattgcccaggctttttcgtcaaccgcgtattgtttccttatctggcaggcttcggcatgttactgcgtgatggcggtgatttccgtcaaatcgacaagatcatggagaaagagtttggctggcctatgggtcccgcgtatctcatcgacgttgttggcattgataccgcccatcatgctcaagctgtcatggcacaaggttttccagagcgtatgactcgcgattatcacgatgccattgatgtattatttgaaaatcagcgttacggccagaaaaatgacgtaggtttctataaatacacccaagacaaaaaaggcaagccgaaaaaagagcaagatgaaaccgtcgatcaactgctggcaggtataagtcacccgaaacaaattttctctggtgaagatatcattgcccgtaccatgatcccaatgattaacgaagtcgttcgctgcttggaagaaggtgtcattgccagtcctgcagaagcagatatggcgctggtttatggtttaggcttcccgccattccacggtggtgttttccgctatctggatacgatgggaaccgcagcttatgtgaaactggctgaacgttatgcccacttaggcgcaatgtatcacgttcccgctggcctgaaagcgaaatccgaaagcaatgaaagttactaccctgccgcagccaaaattgctgttaatccaggtgaaaaagcgtgaggtctgaaaacatggaaaacgtagtcattattgatggtattcgtaccccaatggggcgctcaaaaggtggtgtattccgtcaggtccgtgccgaagatctctctgcacatctgatgaaatcgatactcaagcgcaacccatcagtacaacctgagcatatcgacgatatctcttggggatgtgtgcaacaaacgctggaacaggggttcaatattgcccgtaattccgcattgctggcaggtattccccattcggtccctgctgtgaccgttaaccgtctgtgtggttcttcaatgcagtcattgcatgacggtgcccgcatgatcatgactggagatgccagcattgcgatgattggcggtgttgagcatatggggcatattcccatgactcacggtgtcgattttcattcgaaattaaaccgcaatgttgctaaagccgcaggcgttatgggcttaaccgcagaaatgctggcaaaaatgcacggtatcagccgcgaaatgcaagatgaattcgccctgcgctctcatctacgagccgcacaagcgacagaatcaaaagcgttttctaacgaaatcgcaccaattcatgggcacgatgctgatggcaacctgaagttcatcgattttgatgaagtgatccgtcccgataccaacctgaaaaatctggctgggctgcggccggtctttgatcctgtcacaggcagtgtcacggcgggtaactcttcagcactttcagatggcgcatctgcgatgcttatcatgagtgaaagcaaagccaaagaattagggttgaaagcacgtgcccggatccgttcgatggcagttgttggctgtgatccttccatcatgggttatggccctgtacctgcaacacagatggcattgaaaaaagcaggcctgagtcttgctgacattggccttattgaattaaatgaagcatttgcagcccaatcactggcctgtatgaaagggctgaatctgttggatagtatggacgataggatcaacctgaacggtggtgcaattgctctcggccatccattaggctgttctggcgcacgcatcacaactaccctgcttaacctgatggaacgcaaagatgtacagttcgggctggcaactatgtgtattggattagggcaaggcattgctacaattatcgaaagagtttagctgttcagtatctgacgattgagatttttaacattttcccttgtctgtcttatctattgcatcactcgaaattaagttgttgccgtcgtttcccgcctgtcaggggcgggtttttttattgttatcgaacggtcgggtcaaaaacactcagatcagataaactcaaacgcatcaccatacatgcgatcaatagacgcatcacgttcactacaaaagcgttcacgggcaattttagccatttcaaaacgcccagcaatataaatgtcatggttcgccaaactgccaaaatcttctaagactgcactcaagaccgtacccgttctgccctgccagtattcatcaacctgttcaaccacaggcaccacagccagattgggataacactcactcaatccctgcaattctcccagatcatagaggtgatgtaattcacgccctccccagtagatcgagatatcgcggttcggatttttttccagtgctgacagtaaaatagagcgggtataagagaatccagttcccccggcaatcaataacatcgggttttcactatcttcacgaaaccatgcctgaccatgtggaatatctatatcgatcactctctgatccaggatcctgtccatcaccgccattgcatacaggtttaactcagaagcccctatatgcaactcgatcgtctgtttttctgatggtggcgatgccatggaaaacggacgcttatctctttcatccataactaccatcaggtattgccccgcacgaaaagaaaaaggcgaatcaggtaataaatgaacccgataaacggtatctgtaatggagtcaaccgatgtgactttacagctcagtgttgtcatgcgttccctcttatcgcttcaaaatttctaatttatcccaaatttcatcgacacgggcgcgaatttcatcactcatgactatcgggcgcccccattccctttgtgtctctcctggccatttattggttgcatccaatcccatttttgagcctaacccagaaaccggtgatgcaaaatcgagatagtcgatcggtgtattttccattaagacagtatctcgctgcgggtccattcgcgtagttatcgcccaaatgacatcattccaatctcgcgcgttgatatcatcatcacaaacgataataaattttgtgtacataaactgccgtagatatgaccagactcccatcatgacccgcttggcatggcctgcatattgttttttcatcgtaacgaccgcaagccgataggagcacccctctggtggcaggtaaaaatcgacaatttcaggaaattgtttttgtagtattggcaccagaacttcattcaacgccacacccagtaccgcaggctcatccggtggacggccagtgtaagtggaatgataaatagcgtcacgacgctgggtgatatgggtgatagtgaatactgggaacatatccacttcattataataacctgtgtgatcgccatatggcccttccggtgccatttcgtccggttcaatatacccttcaaggataatttccgcactggcaggaacttccagatcattggacaagcacttaaccacttcagttttatgcccacgcaacaatccagcaaaggcatattcagataaagtatcaggaattggagtcacagcacccaatatcgtggcaggatcagcacccaacgcaacagaaacagggaaacgctctcccggatgagcctgacaccattcctgaaaatcgagcgctccaccacggtgtgataaccaacgcataatgagcttgtttttacccagaacctgctgacggtagatacccaaattctggcgctctttatttggccctctggtaacagtaagcccccatgttatcaatggcgcagcatcttctggccagcaatgcataacaggaatacgggtaagatcaacctcatctcccgtccagacttgctcctgacaaggtgcagaattgaggcgcttggttggcatattcagaacttgcttgaacttaggcagcttatcgaccagatcacgaaaaccttttggcggctctggctctttgaggaaagccagtaatttgccaacatcatgcaatgccttgacatcatcctgccccattcccatagcaacccgcttaggtgtcccaaacagattgcacaatactggcattgaatacccttttggattttcaaataataaggcaggaccaccggcacgaagagtacgatccgcgatttctgtcatttccagataaggatcaacctccatacgaattcgttttaattcacctgattgttccaacaaggaaagaaagtctcgtagatcacggtatttcatattattcatttgtgccggtttttaaggaggaagaacattataaaccctcccatggtggttacaaggcaaactcataacttactaaaaataaatgcatttatttatattttgtgagtttaactgctcagatgcagcaaaatggtatccaatcaactaatgcctgtgtatcacattattcagggaatgttttaccgtgctgaaaaagtctgaatccttcactcatctttcaaattgctgttttgttgactgcgttcattcacttgccactgcgctgtaatttgcaatctatcaggtatacacgttacacacattctgactttattgatgatcctgaagccttggttttgttatgctagacatattgtgtaatggagtcggaatattatgggaagctggtatcttctgtactgtaaacgcgggcaaatttctcgagcaataggacatttagagagacaggatgttatttgcctgacacctacagccaaaattgaaaaaatcgttcggggtaaaagaactaccgtcactgaacccctttttcccaattacctttttgtgaattttgatccagagattattcataccacgactatcaattcaacgcgaggcgtcaatcattttattcgtttcagcacttatcctgctgttgtcccacaaacgttgattgatgaattaatgtccgcaacagaacaggaatatatcgcacctgaaaccccaattactggtgatactgtactgataactgaaggaattttcgaaggtattcaagcaatttataatgagccggatggagaaacccgctcaattctcctattaaatattctcaacaaagaagtatccaaaatattagataataagcaattcattaaaatttaatcagcaaaaacgggctactttgcccgtttttattatctgttttttatctatttcattaaaaataatcagtatttctgctcattcaaccattgtgctacacgcttggcaaaataagtcagtacgccatcggcacccgcacgtttgaagcacagcaatgattccataatggctggctgttctttcaaccaaccattttggatagcagccacatgcatcgcatattcaccagaaacctgataagcgaatgttggcacaccaaaagtatctttcaccctacggatcacatccagataaggcatacctggtttgaccatgacgctatccgccccttcttgcaaatcctgtgcaatttcctgcaacgcttcatcgctgtttgctggatccatctgataggtcatcttattgccgcctttcaaattaccgctagagccaattgcatctctgaatggcccatagtaacaagaggcatatttggctgagtaagccataatctgcgtgttgatatagccatcgacctcaagctgatcacgaatggcaccaatacggccatccatcatatcgctcggtgcaacgatttcagccccagcttcagcatgggatagcgcctgcttaaccagaatctctttggtaatatcattgatgacatacccatcctgatcaatgacaccatcctgtccatgcgtggtaaatgggtccagtgccacatctgtcagtaatcccagctcaggaacctcatttttcaatgcacgaatagagcgctgaatcaaaccatcagggttataggattcctgcgcatccagtgattttttgtctgcttcaatggctgggaacagagacaaaacaggaatacccagtcgggcaatctcttcggcttccttcagcaaaagatcaattgtcagacgatacactcctggcatagaagacacttcttgacgttgattaatcccttccataacaaaaacgggataaatcagatcattgacagtgagttgattttcagcaaccagacggcgggaaaaatcatgacgacgtacacggcgcatacgacgaccaggaaacgtacctggaaatacatagctcattactgctctcctaatgtaaaacccagcgacaatacgccgggttaatgttgtcatcgctccgctaataatcttaacaccatcattcagttagcgataatcatcaatggcagatggctagttatttttctggattgttaccttcatcatattcagattcgttttctgctctgcctgattttcgtccacccacataaaactgagaaagcagaattcccacttcaaataacagatacatcgggatagccagcaaagtttgcgagaaaacatccggaggtgttagcaacatgccaaccacaaacgcaccaaccaaaatgtaaggacgttttcttttcagggattcaggcgttacaactccactccaacacaacaaaataatggctaccggcacctcaaatgaaacaccaaacgccataaagagggccatgacaaaactcaggtaattactgatatctgtcgaaatgaccacccctgctggcacggttttgacaaaaaaaccaaatgcaatgggaaataccacaaagtaagcaaatgccatgcccagataaaacagtacactgctggaaaacagcaggggcatgatcaaacggcgctcgtgtttatataatgctggtgcaataaatgcccagacctgatacaggatcatcggtgccgatacaacgatagacaccataatagtcagtttgattggcgtaaagaaaggcgatgcgacatctgtcgcaatcatatttgctcccttcggtaactgttccattaacggtgcagcaataagccgataaatatcattagaaaaataaaccagtgccagaaaaatcaccagcacggtaatcaaactatttaaaatccgcttacgcagctcaatcaagtgaccgataagaggttgggtatcatccacagacatgttttagtgttcactattggctttttcaggagattgatttttattttgttttgacgccgattctggtactgagtgagatacagaagaatgaaaatgtgtttcatcctcttctaacgctttagcctcttcaggagtcagctgatacgattttttcagcgattcagcagcctcccttaactcgtccatcgatgcctttaattctggggacaatgattgcaaatctactttttcttccattttttttaagctgtcctgaagctcttgcacttttagctcctgagcaagttcattctggacattagccgccagcgagcgtaatacccgtatccagccagctactgttttgactgctataggcaagcgttctggccccaaaacaaccagaccaatcaccatcaccaacagcagttcgctaaaaccaatgtcaaacacggtttatacctgctctttatttttgctctctgatttttcggcaacagtggacttttcagcaatacttttggtgtcaaaatcagcatcatggctatttttctcagcttgatctgacttttcatcatcacttatcgcttttttaaaacctttgatcgatgctcccaagtctgaacccagagagcgaagcttattggtaccaaatagcaatacgacaatgacagcaataatgagtaattgtgggatgcttatcatgactgacctctattcatagggaataataacgactaatatgttcaaaaataccgcaaccacactattaaggctacggcaaaataacctttacttaagcctgcgccaaccaaatatccacgatatgactgccgcccccatcaaccaccacgatagatgaatcttgtcagtcatgaaaaacagactaccacagataaacaatgtcgcgccgatccccagtaaatagagagattttttctggctgacctgttgtttctgtaattgctgcgatatctgatcaatgctcgtctgcaaacgtttatgctgttgaagagcaccataaaccagctcagggaattcgggtaatttttcagcccaatatggcgctttttctttaaatgcgcgcacaatcgccggaataccaacctgatcgtgtaaccaatcttccagaaaaggttttgctgttttccataaatcaagctgaggataaagctggcgccctaagccttcaatatacagcagcgttttttgcagcaaaaccaactgaggttgaaccgccatattaaaacggcgagccgtattgaagagattcaacaggacatgaccaaatgagatttcagccagcggcttttcaaaaataggttcacagaccgtacggatagcaaactcgaaatcttccacattaatatcggctggaacccaaccagaatccacatgaagttcagccactctgcggtaatcacgattgaagaaagcaatgaagttttctgccaaatagcgcttatcgtctttgttcaatgaaccaacaataccataatcaatgccgatataagtcggatcttccggccgttcataactgacaaaaatattgccgggatgcatgtccgcatggaaaaaactgtcacgaaatacctgcgtgaagaacacctgcacaccacgttccgcaagcagtttcatatccgtgttccgtgcttccaacatagcaatgtctgacacgggaatgccataaatacgctccatgaccagtacattctcccgacaataatcaggataaatttctggcacgtaaagcattgagctatcttcaaaattgcgacgcagttggatcgcatttgctgcttcacgcaataaattcagttcatcaagcaacgttttttcgtactcacgcacaacttcacgcgggcgaagacgatagccatcgggcagtaaaggaaccagatgcgccatacggtacattaaacggacatccgctttaataacaggcaggatatctggacggatcaccttaagaacaacttccttaccattctccttaagccgagcagtatgcacctgtgcaatagaagctgaagccaatggctgtgagtcaaaatcatcaaaccatgtttccagcggtccccccaaagcaatttcaatggatttgcgagccacggcaccatcaaaagaaacaacccgatcctgcaacattgagagttgatcggcgatagctggaggaaacagatcccgacgggtagaaagcatttgaccaaacttgatccacactgggccaagttcttgcaatgccaggcgtaaccgctcaccgagtggtttatccttgtgtcgattgggaagccagaacaagaaataacgcccgaagcgcaacggccatgtcagacgaatattggggatcagctcatctaagccataggaaagaaagacccgaacaataaagtaaaggcgttttatctcactaggagtcatattttccctccagtgccgccagccgtttttccatatgagacatatcattggcaactgcattgacttcttcactaaagtaagccacttccagcggattgggcgccactcgccactcttccgtcaatgattctgtaaggtaggttttctgccttgtaatggcattactggcaagtttaatgcttcccttcatcacccggctgaggccttctgccacaatatcgccaacataaggggaaagataatgagcaggatcccactcagacatatccagcaaagccgaccattgctgcataacttgcatatccccttcgataacaatttcaccactgttaatcagagatgaaagacagtgacgatctcgcaatttgagtaacgcagtgaacgtcgttttcatcgaacagtcggcagactctgaccattggctcaaaacatccacctgtttttcactgaatatcaataccagtggtgttttaatttctttcaattcaatggacagtaccttacctgccagcctcatgcgggaggacttcaatacggtttcacggtacagaagatgattcagagtcgtttccagaaacgcagtcagcaccggaaacaacaccgtagaattcaggttgtcacttaattcgggcgtctccatttcagaatttgaatcctttatgcagtgcaacgatccccccggtcatattggtgtaagaaacttggtcaaagcccgcttcttccatcaaagattttaatgtttcctgatcagggtgcatacggatggattctgtcaggtaacggtaactgtccgcatccttgacaatcatctggccaattcggggtaaaacatggaacgaataagcatcataaactttgctcaaaggtgccagcatgggtttggagaattccagcaccaaaagacgcccaccgggtttaagtactcggcacatagagcgcaaggctttttctttatccgtcacattgcgcaggccaaaagagatggtaatacagtcaaagtaattgtctgaaaaaggcagttcttccgcattggcctgaacataattaacattgcctacgataccgatatcacgtagtttctcacgccccactttcaacatcgattcgttgatatccgccagtacgacttcacctttctctcccacgatgcgggaaaacttcgccgtcagatccccggttcctcccgcaagatccaacaccttatgaccacggcgaattccacttgcatcaatggtgaaacgtttccagatacgatgaatgccaaatgacatcaaatcattcattaagtcgtatttcgaagcgacagagtgaaatacctcggccaccatattttgtttttcatctttttctacggtgcggaaaccaaaatctgtagtttttttcgattgatcagccatgttatttgcccgctttttattcaaaaaaatttatagcaagtgtaccagcctttctgacaaaaccctatccacacttcattcattaacctgcaatgattggaaagatttatcaataagctgtgaatcaatagggcgcttaacatcaacacctaaatcacggaacccttcagcctgactaatcaggtttccccgcccctcagccagttttttcattgccagatggtaactctcctgtgctttattgaggctgtgtcccaacccttgcatatcatccacaaacaaccgcatcttgtcatacattctggttgctttgtccgcaataaggcgtgcattctgactctgatattcatagcgccaaagattattaatggtacgcacggcaaccagaagtgttgatggactaaccagcataatattatgtttcaatgcttcatccagtaattcaggtgcttgattaagtgccaccaaataagccggttctatggggataaacatcaaaacataatccagcgaccgtaaaccgggcaattgttgataatctttccggctcagcccccgaatatgtcctttgattgagtttatatgctcctgtaacgcttgtgcctgctgcgtgtcatcatcactgttaaagtaacgttcataggcgatcagtgacattttggcatcaataatgacatctttttcctgcggcaaatgcacgatgacatcaggctgaaagcgctcaccgttttctgttttaatgttgacctgtgtatgaaattcatatccttcacgtaaaccggaagattccaaaacacgtgccaacaccatttcgccccaatcgccctgcattttattatcccctttcagagctttcgtcaggttgatcgcctcttttgccatttgtgcattaagttgctggagattgcggatttcatgggtcagagtatggcgttcgcgagcttcctgtccgaaactatcctgtacttgactacggaacccgtcaagctgctcgcgaaaaggcatcaggaggtcattaaggctttggcggctgtattcatcggtacgacgccgattctgctcaaaaatacgattggcgagattttcaaattgggtattgaggcgttgttcactattgatcaatagacgctgtttttcttctgcggccagcctgctctcttcaagccgtgtgcttaattctcgtaattcaacttcctgtacactgttgatttcgcgctgtgccagcagttcttgatttaattgatcacactcagtacgccaatagtgggactgttctaacttttcatggctgatagcaagctgactatgcagttcacgcagttccaactctttctgttgaattcgctggtgaacagaaagccagacgaaaatccctccgcccagcaatccacttaaactgccaatcagcatgtataaccactggatatccacctatacgcctcccactgacttcaccccggttaacttcaccttaatgtaagttaaatagatgctgtatagatgtccagattctttaatgagtttctttcagtttgcaaagcggctcgcaattagcccatccattctgccagccagcgtaaaccaaacgctcccggagccaaaataccgaaggcccaaatcagcgcagaggcaaaattggcaagctggaaatgacgtttcggcatggcgcaaatacccgctaccagtggtataacagctctcaatggaccaaaaaaacgcccgatgaaaacaccccaaactccccagcgttcaaaaaatcgatggccgcgcactaacatttgcggatgacgtgacagtggccacatcttgccgacattgtccttgtagtgggcaccaaacagataggaaacccaatcgccaaaaaaggctcccgctgctgccgctatccatattggccaaaaatttaacccgctttcaccaatcaacgcccccaatcctaataaaatgatcgtcgcaggcaacagcagggagataaatgccagagattcaccaaaagcaagtagaaaaacaatggggattgcccaatattcatgggcttttacgaagtctgtgaccagttcgataatttcatgcaaactcaaattagctgttcctgtatcaattcatcagatgtaccaagttagcacctgatatataaaccaatgctaactcagtatttttattcaagaaaataactttgtaatttttcacgtgctgtcatatccagcccgatatctttttccagccagatatccacactgccataatgctggttaatactatttaaggccgttagtaaaaactcttcctgcactgaataaacataagcaaatttttcaatcacacggtcactcatgacttttgcatgttcattcaagagatattcccgatacggtgccagcgtaacgttggtgactaaatagtcttccattaccgtatccaaatctgctcccagagcaaacagcaccagcgcagatccaacgccagttctgtctttacccactgcgcaatgctgtaaaattccgcctttctctggttgcaccaatagattagccagctttttgtaagcaggattgctgattggcaataattcgtataaacgcagcatgaatgctcgttcatcaaactgctccagacgttcctgacccaatttttccagattggcatcaacttccttagagagtggattggccggagcatgatgataattcgccccacgccacactcgatctggtttatcctcaatttcgctgctatcacgataatcaatgatctggaaaaggtttttgctcatcaaaaaagtctgatcattttcagtcaacatgtccaaagagccagagcggaataacagccctgatttaatttttgcaccattatgcagcgtcttattaccgaaatcacggaagttaatgccaccatgtaaggggagtaatgaaggatgggatagcaatgttgtggtcatagttactcttgttatgatttaaatagatcgttattgataaaaagcgttatgacattatcagattttagaatgaaagaaagataagcagaaagatcgagccagagtgttctggcccttaatgaaagcgattacagcaaacggcgggcggcatcaactacgattcccaaagcgttgctttcggtttttttcaacagttccacatctggaatttcctgttgcgtccggttgacgatcacccctgccaccataccagcgcgcagcccctgacttgcacacatcgtcagcaaagtggctgattccatttcataattcatcacccccatttgctgccactcttgcatggagccttgaaaacggcggacgacacgaccagagtatgtatcgtaacgctcctgccccggatagaacgtatcggaagaagccgttataccaacgtgggtggccgatcctgatgcttttgccgctgcatacagtgcgttggtacattcaaaatcagccaccgccgggaattccattggtgcgaagtgcaggctagccccatccagacgaactgccgctgtcgtgaccaatacatcacccacattaatgtgcggctggatcgcaccggttgtcccgatccgcaggaaagtactcacccccaattgcgccaattcttctacagcaattgacgttgaagggccaccgatacccgtggagcagacaaccacgggctttccgtcaatttctgcgcgccatgtcgtaaattcacgatgagaagccagatgaacagggttatccatcaattttgcaattttttcaacacggttgggatcgcctggaacaatagccaaagtcgctccttgcagatcgcttttggtgatacctaaatgaaatacatcagacatatcgagctcctcaacggaaataattcaaaaacagggatacctaaatttagtgcctaatctgacactttttagtgataaaaatcatctttaattgataaagataaagaaacacatacataattttgtgataaaaatcacattcataatccaaaatgacggactgagtataagattcaaataaggccaatacttattactccgtcacagagtcaacaagcatcaaacggcaaaacctcggtataacccgccatattctgttttaatcccgcaaaagtggggtggatctgcaatattatgcaaatgtaataattacatattgcatctatctttatttaataacatgactattgctttatgcttattaatgcatctaagcaagtgctttatgtggtcaaaccaataaatcatcaacaagaagggagttacgatgggcttttttgatcaaatcatcaatatgctgagtgggtagcacaatccattcgtggatcggctcaggagatattggggaaataattttttcgcccgccacattttatttgctgtagcgggcgttcttcagtttagttatttacggaagtattgttcacggaagcacgcagacgtttcgccgcttcgaccatgttcgccagtgcctgacgggtttcagtccagccacgggttttgaggccgcaatccgggttaacccacagacgttccactgggatacggtcagccgctttacgcagcaacgcttcaatccattcgacactaggcacgttaggtgagtggatatcatacacaccaggcccaatctcattcggatatgaaaaatcttcaaatgaatccaacaattccatatctgaacgagacgtttcaatggtgatcacatccgcatccagtgctgcaatggaaagcatgatgtcattgaactcgcaataacacatatgggtatggatctgagtatcatcctccgcaatcgcggcactcagtttgaaagcatccaccgcccattccagatattcctgccattcttccctacgcagcggcaaaccttcacgcagtgctggttcatcaatctgaatgataccaatacctgctttttgtaaatcatcaacttcatcacgcaaggccagtgcaatctgtttagcaatcgtttcgcggctaatatcttcccttgggaatgaccagcagaggatagtcaccggccctgttaacattcctttgacaggcttatctgtcagggattgtgcatatgttgcccaatttacagtaatggcttccggacggctgatatcgccaatgattactggcggcttaacacaacgggaaccgtagctttgtacccagccattttgggtaaagacataaccatcaaaatgttcaccgaaatactcgaccatgtcgttacgttcggcttcaccatgcaccagcacatccagtcccagattttcctgttcattgatcgcctgcttaatatgttcagaaatattggtgcgataatgcgtgttatccacacgaccttttttgaaatccagacgcaggctacgaatttccgttgtttgtgggaatgatccgatagttgtggtcggccacaacggtaaattgtaacgttcacgctggagtttggctcgttctggataaaccagattacgctcgctatcctgtggtttgatcgccgtgatgcgctcagtcaccgtcggattgttcacccttgtggaactacggcgtgcacggattggcgcactgtaagcatccagttcagcctgtttgctgccttccggtgcattcagtgcctgtgccagcaaagacagctctgcgcatttctgtaatgcaaaggcaaaccagcttttaacttcttcatccagcccggtttcatcgttcaggtcaatcgggctgtgcagcaatgaacaggacgtgccgatccaaatatcacgcttgcctgccagcgatgccacaagctggtatttagcactcaaatctgctcgccagacgttgcgcccattgataacccccaatgaaagcaaccacgtttccggcagagatttattcaattcatcaagggaatccttccctgcaactaagtcgacatgcagcccttgtactggcagtgatttgatcgtcgccagattatggctgatgctatcgaaatacgttgtcagcagtaatttagcctgtccttgcagcgcctgataagccgtcgagaaagcctccagccattccttcggtagttccagtaccagtgccggctcatcaatctgcacccattcgatgccccgttttgccaattctgctaatacttgctgatagacaggaagaatatccgttaacagggagaggcggtcgaaggctttacctttcaccttgccgagccataaataagttacaggccccagtagaacaggtttgactttgtgtcccaatgccagtgcttcatccacttcatccagtaattgagtccaggtcaatttaaattcttgcccctgctgaaattcaggtacgatatagtgataatttgtattgaaccatttagtcatttcagaagcagccgctggtgtgcctgttggagctcgaccgcggccaatacgaaacagcgtatccagatcaatgctaccatcttcattctgatgacgtggtggcacgttgcccaatagcaagttagtcgtcaatacttggtcataccaagcaaaatcacctaccggaactaaatcaactcccgcctctttttgctgttgccagtgacgtgcacgtaattcacgacctgtttccagcaattcctgttgagaaatcttgcctgcccaataattttcttgcgccttttttagctctcttttcaagccgatacgtggaaaacctaatgtatgattcaaaactgtcatgtcgtcacccgcaaattttagccgtctagatgtttacacttctataatcaacaggtactgtataaaccacaagcgcaaattattcatcatcaacttgaaggtttttcatgatcgaaataaaacatttaaaaacactacaggcattgagtcattgcggttcattggctgcggctgcaaatcatctgcatcagacgcaatctgctctttctcatcagttcagtgaactagagcatcggctgggattcaaactcttcattcgcaaaagccagccattgcgccttacgcctcaaggggaagtgctgttaaaactggcggggaaggtactccctctggtgacggcttccctgcgtgaatgcagtgaaccggaagaaattaatctgcgcattgccattgaatgccatagctgtattcagtggctgacgccagcactgaagcgttttagtgaaagctggccgcaggttagtgtggattttaaatccggtgtgacgtttgatccgcagcctgcactgcaacagcgggaactggatattgtactgacctcagatattattgcagacagcaagctgaactatacgtcgctgtttgactatgaagtgaaactcgtgcttgctccggatcacccattagcaaataaacgcgatatctatccacaagatctcgctcccgaaacgctgctgatttatcccgtccagcgccaacggtttgatatctggcggcggttcctccagccagcaggtgttaccccgacattaaaaagcgtcgataatactctgttactgatccagatggtggctgctcgcttaggcattgctgcattaccccattgggcagtagaaacattcgaaaggcaggggctggttgtgacaaaaacgttgggagaaggattatggagcagattgtatgctgcctgccgagaaggagaacagcaccaacctgccattaatacatttattcgttctgcgcgccagcacgcggtggacaatttgccgtttgtaaaacgggtttcaatatccaacggtgatgcacccaaagagatgcaacaatcaggctgcttcctatggtaaaacccagccaatcaggatgctgctgccaaattaaaaaattgaccaacaacccggccggaaccagcatattattcataatcgccagtgttccggtatccacttgggttgcgccatagttccacataaaataaccaatgccagaagcgcctgcacctaaccagatcaggacgccccattgtaattgtgttgtcggcaatttatatggatcaccaaacagcagccaaccaatggttgcgaccacacaagcccccagatagaaccacgaaaacgcgacccgctgcggtatcggatacacttccatcaaacgcttatagccaacctgacctatcgcaaagaaaatattcgccaactgcaccagtatcaaaccaatccaaaaagattcgctcaatcggtcataacggataatcgctgcgccagccactgccagcaaagaactcatcgcatagccccaacgcaatcgctgacgtcccatcacatcatatatcagtgtgacatacagcggagtcatcaccgtaaacagcaaaaattcagcgacagtcaagtagtggtaggcatgaaatacaaacaaatacatcacgccaagctgacaggctcccacgaccatatacaatgagatcactttcagcgataacccacgccagcgcaaaaacggcaggaataccaaggccgccagcacaactctgataaacacggaaaaccagctatcaacctgaccagcaaggtaagcaccaatcaggctgaatgaggcagcccacaaaaaagttgtgatcgttaacagccacataatttattgatctttaaccacaagtaatgcttcaagcaaatccaaatcatgcagcagcgtttggagtgtttcattactaatcttacgggttgcacgtagatgatacagctctcccctttcggcccttaatgccgtcaaacggaaacgtcgttccaactcctcaaccagcaagttatgttcgatttcatctttacccacggtacgacgccgcaaataacccgtgactcgggaagcaatttcactcactacctctgcatccagtttttcttcggtgctggcagacaagcgctcttccattttattcatactgacaatcgcaacttcagccattgctgctttcgccattctgatttcattgatatccgcctgcttatctcccactttcataccacgcagcaacagtggcaggacaacaacaccgacaaacagggagaacaggatcacgcccgctgcgatgaaaatcaactgataacgcgctgggaatggatctccatccggcaagaaaagcgggacagataacgcacccgcaagcgtaatcgcaccacgtacacccgcaagcgacgccagacacaattcacgcatagtgtaagaagcaaattccagcggttttttcttcattaacaccttgctggcatttttcatcaaccataaccaacagaaccgcagcaataccaacgccacataaatgatgccaaccgcagcaaacagcatccacgtttcaacttgcggatcaagttcagcctgctcgacagacgtttcccagatacccggcaattgtagccccagcatgacaaatacaaggccgttaaagacaaaggccagcattccccatacgttatcggcacgcagtcgcatagccagaggtgcattgcggattacgccagatttactgatagtcatacccgcagccaccgcagctaaaatacccgatacgccgatatgttcagcaatcatgtaggaagcgaatggcagcagcatcataaacatgatttgagttgctggatcatcgccactccagcggctcatcaatcgcaacgatttactgtacagccatgtaatggcaataccggacagcagaccaccaatcgcaactttgaaaaactctattgtggcgccagtgaccgtaaataccatcgttcccatggcaattgccacggcaaacttcagtgcaaccagaccagaagcatcgttcatcaacgcttcaccttccagcacactcatcatgtttttcgggatgcgcccttttccaacaattgatgacaacgcaaccgcatcagttggtgacagcaccgcagccagagcaaaagcagcaataagaggaatacccggcagcaaccagtaaatcaagtagccaataccgacaaccgtcactaataccaagaataaaaccagaatgactatttcacgcccatgttgaaaaaattctctggtcggtgttttccagccatcaacaaataataaaggagggataagtaaaacgaggaataattcaggatcgaaagtaacgtgtaaaccaaaatgaggccaagccagtagtgctcccatagctatttgcactatcggcaagggaatgcggaacgggatcattttagtaagaacacctgaaactgacaccaccaaaatcaagatcaagatagtaaaaaatatttccatattacccttacaaattgccaaaaatccgtcggtgaagagattgtgacttttttttcactctaataacagccgtaataaccataaatattaaagttattaaagaaaatcaaaaaacaatcacattgtgaatcaatgatcagtaagtcattagtctattttatacttatcggcgggagtgtgctgaaaaattaacacgttttaaaatttatccgacaggaggaagtatgcgcaaaccctgaccggctgcgcatgattttcttatttagatagcccaatttccggcataaaatatcactagcacgatagcaatgatcaccgtaccgatattcagtttacgccactcaccagagaaaactcgcccgacaaccaaagcactgaaccctagcataatgccggtgacgatattacaagtcagtacaataaacaccgcacacagtaatcctgacatagcttcgacagaatcatcgaaattcagcttccgcacgttgctcagcatcagtagcccgacatacatcaaagcaggggctgtcgcataggccggaaccaggtacgacaacggagaaaggaataaaatcagcaggaacagaatacccacaaccgcggcggttaagcccgtcttgcctccggcggcagtgcccgcagcggattcaatgtagacagcagcaggagaagaacccatcgcgcctgcaaaaatactgcttacggaatcagccgtcagagctttgcctccattgataatctggccgcctttatccaataggttagcttgccctgctacggctcgaattgtccctgtcgcatcaaatatcgctgtcatcaccaatgccaagacactcggcaacactacaggctgcaaagctcccacaatatccatgctaaacatcagagacaacccatcttctcccaacgttggcagcttaaaaaatccttgatatttcactgcgggatcaaaaatcaggccgataattgagataacgataatgaccaacaaaataccaccgggtactttcttcctttccagaccaataatccccgccagacctaataacgtcattattacgggaaatgcagtcaatgagccaaaagcaaccggtaaaccggcatgaggatttttaatcaccatccccacaccatttgccgcaatcagcagcagaaacagcccgataccaataccggttccatgagcaattcccattggcatattgcgcaagatccaagaccgaatccccgtcactgaaatcaccgtaaacaggcatcccatcaggaaaacagcacccagcgccacgggaatactcacctgctgtcctaaaaccagactgaacgctgtaaatgcggtcagcgagattgcacagccaattgccatcggcaggttaacccacaatcccatcaataatgagccgatacccgtcaccaaacatacagaaataaagaccgctgtatgaggaaatccggcttgccccagcatgcccggcacaacgataacggaatacaccatcgccagaaatgtcgtcaatccagccaaaatttcctgacgtaccgtcgttccgcgttcagtaatcttaaaatacttatcgagtttgcattgagttggtgcctgcatgccagacatgtctttcccctgccattatgttgaatttctaacgctatcatctctccactttgcctaacgaaaacgattacgtcgtaagatacttaaaattggtgctgtactcattagtacagccacttcaatacgcaatcgtttggcttttcagataaaaaaatggagagagaatttgaggcgaatgattatccagtgaataagggatgagaatcaagagataatcataaaatttgttgtgagttatctccgtatgtactgagaacacactaaaaagatctacttgtttaagcctgttcatcaaattgtgtatgtagcgcgccacgtgaattgaaaaaatgtgccatttaaatcgagaaaaattagtacatggtgattttatcaaaacacgtggcatatttagattcttttgtggtcggtaagaatcattttttctttaaccaagtggggataattttacaggaaagttgagaaaaaaagcaccgcaattgcggtgcattaaaaaaatcactatggacagacagggtaaatgtacaggaagtgaaaaaaaacagtagcatatgctacaaagtctggtctaccagacaacttgcaaacacaacatcacaactacaaagccaaaagcttcaatgtatcactacagagttacttttcgttccggcttaggaagttgcgcacactatagggatttgctggtatatcatcaatggacaaattataatgattcggattacaaaaactaatacctgagagaaaagaagtatcggtatcgccactatcatataagaaacgaacatgtctaaacgtttaccaccccttaatgcgttacgcgtttttgatgctgcagctcgtcatcttagttttactaaagcagcagaagaattatttgtaactcaggcggccgtaagtcaccagatgaaaagtctggaagactttctgggattgaaactttttcgtcgccgtaaccgttcactactgctgacggaagacgggcagagttactatctggatatcaaagaaattttcactgctatcaatgatgcaacccgcaaacttcaggctcgcagtgccaaaggtgcactgacggtaagtttgtcaccgagctttgccattcagtggctggtgccacggctttctggtttcaatcagagttttccgggcattgatgtcaggattcaggcggtggatagggaagaagataaattggcagatgatgttgatgttgcgattttttatggcagaggcaattggccaggcatgcggacagatcgtctctatcctgaatatctgctacccgtttgttctccctctttactgatgggggaacgcccattaaaaataccggcagatctggccaagcatactttgttgcacgattcttcccggcgggactggcaggcctatattcgccagcttgatatgcagcagcagatcaatgttcagcaggggccgatattcagccatagctcaatggtgattcaggcggcggtgcatgggcagggggttgcccttgccaataatgtgatggcacaaaatgaaattgatgcggggcgccttgtctgcccattcaatgatgttttggtcagcaagaatgcattttatttggtttgccatgataatcaggcagaattgggcaagattgcggcttttcggaaatggatcttgatgcaggccgcgagtgaacaggcaaggttaggatttatcactaacgaatgaaaaccggatgtgtgaaggcgtatcacgtcatatatccagaaacaggagcggagcgatgagcagtcgtttcatgcttatttttgttggtatcagcggttttttgtatgtggcattgggggcgatgggtgcacatatgctggcacctgtcctgacgtcacgccaaatggaatggatccataccggcctgcaatatcaagggttgcatacactggtcatgatggtgctggctgctttactgatgaggcagccaacgaagccgtttggctgggcgggtatttttttcgctgcgggaatagtgttatttagtggcagtctttattgtctggcctttttaccgctaaaatttttggtttatctgacacccatcggtgggtttagttttctcattggttggttatgtatattaattggcgctctgcgtctaaggaaatcggcgcctagccatgaataaagttgctttatattgccgccccgggtttgaaaaagagtgtgcggcagaaattactgataaggcgggtaagaaaggaatttacggttttgcccgcgtaaaagaaaacagcggttatgtgttgtttgagtgttatcagcatgatgatgcggatcgtctgatccgtgaaattccgttcggtgaattgatctttgcccgccagatggtggttgtgggtgaattgctcaaaaatttacctcaggaagatcgtattacccctatccttgggatgttgacgggggttattgaacgtgcaggtgagctgcgcgtagaagtgccggataatgatgaaagtaaagagttgatgacattctgccgtaagtttacggttccgctgcgtcatgccatgcgtcaggaaaaattcttgctggcaaaggaaagtgctaaccgcccggtgattcatgttttgtttattgctccgggctgttgttacgtcggctattcttacagcaacaacaattcccgtttttatatggggatcccccgtctgaagtttccgtcagatgctccgagccgttcaacgctgaagctggaagaagcttttcatgtattcattccacatgacgagtgggaagaacgtctgggcagtgggctgtatgcagtggatcttggtgcttgtccgggaggctggacttaccagctcgtgaaacgcgggatgatagttcatgcggtagataatggcttgatggctgatagtttgatggacaccgggcaggtgaaacatcatcgtgtggatggcttcaaatttgaacccacagtgaaaaatgtttactggctggtttgtgacatggttgagcagcctgctaaggttgcccatctcatgacagactggctagtgaaaagctggtgtcgtgaagccattttcaacctcaagttgccgatgaaaaagcgttatgaggaagttgctcagatcttgcagaagatagaacagcaactgaaagaaaatggagttaatgcccaaattcaggccaagcacttgtaccacgatcgtgaagaggtcacggtacatgttcgtcgtatttggtctgcatatgcaatgacccgggatttttaattattgagaaatagataatcctttcttaggatcaattcgcagcatataaaaacagtattatttattaataaataatactgtttttttgttatcaaaaaaattcattttaaaattaataatttattacataaattaaatttaatttatttgtattctaaaaagatatattaattatttttacaccgaatgaaactcacgctattttattcgagagtcttctttttaagggaatcttagaaagaataaaaaactcttactcccgttattatgaaaatttcgggctttagatataaatattgtttttacaggagatttatatgacctcaaagaataaatatacctatgtggggttatctgattccaagtccgttcaggatgttaatgcacttctcacagcctacgttccaaattccgatccgggtattcgtgtcgcacatacaccgctgggaaataaagctcccgatgaacttgtacgaaccaattatcattggacgaataaagtcggctcttccggtgcagtggaattatcatatcactttctagaatctgctccttccgtgatgccaagatttggtattgctggattcagttcctttaatgatgagcagaaagaggccgcactattgtctttacaatcgtggtctgatgttgccaatgtaaaatttaatgaagtcagcagcctttctaaagccaatattacttttggtttctttgattatagtataactgacgactatgcgtttgcgactttaccaaaagggcagaatacgacttattcctggtatagcgcggagagtcgtactttcatagacaatgacattggtgtgaatggctatggccgccagacatttacccatgaaatcgggcatacgctgggtctggatcatcctgccgagtacgatgcttctgatgcggtcagaccaacctatattagtgtgggggagtacttcgaagatagccgtgcctataccgtcatgagctatttcagtgaaaaatacaccggtcaggactacaaaggagcattctcatctgccccactgctgaatgatatctccgccattcagcagttatatggagccaatactgaaactcgtacaggtgatactgtatatggtttcaactccaataccgaccgtgatttcatgactgcaaccaatgccaaaagcaaactggtattcagtgtctgggatgcggatggtaatgatactttcgatttctccggttttactcagaatcaacgtattaacctgaatgaaggggctttctcggatgtcggtggcttgaaaggcaacgtatctattgcccgtggcgtaaccattgagaatgcgatcggtggcagcggcgatgacattctggtaggcaacagtgctgataacgtgctgaaaggcggcgacggcgatgacatcatttatggtggcttgggcggcgatgacctctggggtggcgcaggcaaggatacttttgtttatctgaatggcaaagagtcactgaaaggcaatcctgactggatccatgattttatttccggtgaagacaagattgatctctcagactttaactttggtggtaagggtgatatcaaatttgttgattcattctctggtagggcgggtgaagtcctgctgacttacgacaaagtgaccgatataaccgatatgtctatcagccttggtggtgacttagccagtcatgattttctggtgaaaattatcggtcagcctgtagctgaagctgattttatcgtctaatgcagactggcatatcacgatagcgcgatactgccgtatgtattaataatacggcagtattacggggaggaagttaccgtgttacacaaggtgcaaaggcgtatagcgaagtcttgtttatttaaattggccttatcgataatgttttctctttttttgattggaggatgtatggcgagtagtttgagacttcctgaaccggctgaactgaaagggttatggcagctatcagatggcaatcaggtatgcagtattgaattaacggatacccgtttgcctgaggggtcaatttgggcgctgaaaggtgattcttgcctgaccgaactgatggggaaccctgtagagggctggcgtcctacacctgatggtatcactctgactgacgatgatggcaatagtctggccttttttggccatgagtccgagcaatgggtggcatacctggttgatgggcgggaactcgttatgacattcagtggcacgcattctgtgacaaagtaaatgcagtgacaaaataaaataaaaataacaaatgactgggtaaataaatcgtttttgcttcagttaatgatgaagggattgcagtgaaactacgctttccaaaggatgaaatcacggatgttatccgtgcacgcagcaaagtattctggactattggcttatttacggcatttatcaatctgctgatgttggttccctctatttatatgcttcaggtatatgatcgagtcctgccatccagtaatgaaatgactctgctgatgctgaccctgatcacgctcggcatgttcgctattatgggcgggctggaatatatccgtagcatggtggtgatccgcatcggcagccagtttgatatgtgcctgaaccagcgtgtttataccgcgtcgtatgagtccaacctgaaaaatggctccaccgatgccgggcaaatgctcaatgacttggcaactatccgccagttcctgacgggcaatgcgctgtttgctttttttgatgtgccttggttcccgatctatctctgggttatttttctgtttagcccgtacttgggactgctggcgctggttggggcgatcattttgatcacgttggcggtactgaaccaatggctgtctcagtcgcctttatcggaagcgagtcatctctccctgcgctctgccaatcttgccagtactaatctgcgtaatgcggaagtcattgaagccttgggtatgttgccggcactgcgtcagcgatggtttagcctgcatgagcgctttctcaatttccagcgtattgccagcgaacgggcagcatccatcaccgcactgaccaaaacagtgcgcatggccttgcagtcgttgatcctcggtttgggaggctggctggcgattgaaggcaatatcacgccgggtatgatgatcacgggttctatcttgatgggacgggcattgtcgccgattgagcagttgatccaagcgtggaaaagctggagcgccgctcgtctgtcatggcagcgactggataaattgctgaaggcgcagccagaacgtaaaagcggtatgtcactgcctgcccctaaaggtattttgttgctggaaaaagttgccgcaataccaccgagtaaaacacaggccagacaaacggcggggaatcataaacaggttttgcaggatatcagtttttccctgaatgccggcgatgtgttgggcgtgattggccccagtgcgtcggggaaatctacgctggctcgcctgctggtggggatttggccgtcacaggaaggtgttgtgcggctcgatgatgccgatatttaccaatggaacaaggatgaactgggggcatcgataggttatttgccgcaggacatcgaactatttggtggcacgattgcggaaaacattgcgcgttttaatgacgtggatcctgaaaaagtcattgaagcggccaaaaaagcgggtgtccatgaactggtactcaatcttgaacagggttatgacacggtgattggcactggaggaatgggattgtccggtgggcagaagcagcggattgggctggcacgggcattgtacggcaatccgtcgctgctggtgctggatgaaccaaattccaatctggatgatatcggtgaaaaggcgctgagtcaggcgattacgcaattgcgggaacagggcaaaacagtggtagtgatcacgcatcggccttctttgctctcacaaacaaacaaaattttgctgttggtgcagggaaaaatgaaaatgtttggcccatctcagcaagttatggcggcgctgtcgcagtcaaaaacagtcgaacgtgcctcgtaatgtggctctgccatgtttttatgacacggttttaatcagtgggcagggggaagtttctgcctgggagtgaagatgtcctatcagaccaacgcaaaaagtgcgaaaaatgatgaatcgggattattgccgctggatgcgaatcgctacctgcggctgggctggctggtcatcggtattggcctcttggggtttttcgtctgggcggcctttgccccgctcgataaaggtgttgcttcctccggtattgtggtggtggatggcaaccgtaaaaccgtgcagtcgccagccaatggcatcatcagacaaattctggcatcggaaggggaacaggttaaagccggacaggtactagtgcagctcagtcaggtgcaggttaatgcccaaattgactccctgaaacagcaattgcataccactctggcgacggaagcccgattgctggccgagcagcaaggactggaggtgatttcctttccggctacgttgtgggatcaacaatcggaaccacgcattaaggatattctggtattacagaaacagcttttcctgtcacgtcgtgagatgctgagaagtgatctggcggggatgcagcaggctgaagaggggctgagttttcagctcaaagggttgcggaacgcgctgacaaataaacagcagcagcaggtttcacttaaagagcaagtgaccaatctgcggccgctgaccgaagagggttactttccccgtaaccgttatctggaattgcagcgcagtcaaagtgagttaagtggcagcatggccgagatggcgggacgcattggtcagcttgaaaaacagtgtcaggaaacccggcagcggattatccagcggcaggcagattatcaacgtgaagtccgtagccagctttcggatgtgcaggtgcaggccaatgagctgaaaaacaagctggaaacaactcagtttgatttatcccatacctcaattaccgccccggtgagtggctcggtaatggggctgacagtatttacccaaggcggcgttgtggcttccggggaaaaattgatggaaatcttgccagcccagagtgcgttagaagtcgaagcgcgcctgatggtacatctgattgataaagtcgcaatggggcaggatgtggatttgatgttcaccgcattcaatcagaaccagacgccgaaagtgacaggcaaagtgacagtgatctccgccgaccgattggtggatggggtgacaagagaaccttattaccagatgcgggtcagagtgacaccagaggggatggcacaactggcagggctgcatatcaagccggggatgccggttgaagtcttcgttaaaacgggttcgcgatcactgttgagttatctattcaaaccattgatggacagggcgtcaacgtcactgattgaggagtaacagggatgttcagatcttatagtgttacagggcgtgtcctgtttttaccgttgtttctgctgatgttgttttcaggtacggttcaggcgctttccttaacggaggcttacgctctggcactgcaacacgatccgacgtttcaggcggcgataaaagcgcaggaagcggggcaggaagagaaaaaccttgggcgggcggaattactgcccaagctcgcttttaactaccaatatgttccccagaattggcagaaaatggagtcctcttcttcagcttcagggcaaaggggaaatatgatcacggaaagtcgcaaccgccagtatcacagttacagtggttcgcttgtattgactcagccgctggtggatttcgaggcgtgggcgcgttacaaaacccgtcaggcctacgtgctgatgagtgatgcccgttttcgggtagacacccaacaactggcagtcagggtagtaaacagctatgtggatgtcgcttatgcgcaggacaggcaggcgcaggttgcccagcagcgcagggcttatgaagaacaactggaacgcaatcagaaattgtttgcttccggtgaaggcacacgcactgatgtggcggaaacccaagcccattacagtcaggttgtggcggatgagttaactgtcaaagatgaactggatgcggcaatccgtgacttgcaattgctggttggtatacctttaccagacgatttgccggtcaatcgcctgtcacctgtccagaacttcaagatcataaaactggcttttgcacattatgccgattgggagcagatagcattgagccagaatccgcagttggcggaggctcgccagaaagtggccgttgcggctcaggacattgagcgcaatcgggcaggttatctgccaaaactggagttatatgcttcccataccgaaaataaatccagcagcgataacatcgtcgatcaaaaataccgtaccgattcaatcggcttgcgggtgtcgatgaatctctataatgggggaggaacgtcggcggcagtgcgtcaatcagcagcgaattatagcaaagccaaatatgagatggatgccgaagcgggagaaaccctgaatgcgctgcgacgcaattataacgcctgcatgaacggcgagaagcggatacgtgcctatgaatcggcagtggaagcggctgaattacaggttaaagcaacgcagaaaagtgtggcactggggcagcgggttaacgtggatatcctgaatgcggagcaacagctctacatcgctcgtcgtgatctttctcaggcgaaatatcaatatatgaaatcctggattggattattgagtgaagccgggcaattgaatggagagcatattcaattggcttcgggatattttgagtgattaaatttttccatttactaaactaccaccgactaaagtcggtggtagtttagtaattcaacccaaattgctgtttgtcataacctccgtattccccgtcatcgcgtatttgaaggcgtcgcatagcgagggaaaacaagtacaggcgggttttatggctttaaacttcattgagttatcaatgattgtgttgaacttttagcggttaagccgacctcaggaaataaagatgatcgtcatcccgtcaaagcactggtataagggttaacagggtatggcgataaagggtatttgtcacaggcttaattgcttatacattccaacctgaaaaaccgagcttgaatttacgggattgtgatatcgctatttttaaacaaggctgaggttaaataataaaaaagcaaagctcattcaacattgaaatcacactttgcttttatatataataaatacagtgacattccagatttttatttaaaaacgataacctacaccaagattaaacccgttaatttcctcacggttatcattatattttactgatgcgccttcataaccggcataaaggctgagactttgtatcggattaacttctacaccagcaccataggcgaagttggtcgattttctattcattttactggcctcaacttcgactgtgttgcgtagatgataagccccttcagttgcatcagcttttgaatgtgcaaaaccaagcaaaccatatacacttagatagtcattgatgcggtaagcagggcctgccattagtgaataatatttcatatcaagactatcctctccagtataattcttgccattatgtttaaaactaaatttataatctctatcgcccttcatatgagtaaacgatccaataatactgactggagaatcccattcataacggtaatgcaaatttaccccgcgaatatctttaaaattctgaaccttactttgcgcataacctacagtgacagtatgcgaatccgcataagccaatgagccatacataacgccagagacggctaaggtagcaagaagtgctttttttattaccattattaattaccttcgatgtgatttaccgataaaagtatagataagttatggaatacatcggtaaaaagttctactaatgtgattagtattgaattattgatattttgccttgatcatttacttatcattgtatttcactgaaaaaactaaaatgaactttgactaaaactcgatatctaattgatctattttaatatttatttttggcatacaccaataacctctattattttgtcaatcagcaataaattttgttgtaatttaattagttagcaaaaggataaatcaacgtcatgacattgatgtttttctctatatgaaatattttcatgatgtcttctgattcagaaaagcgtcaaactgcttttcccagatatttaattaaaaggagccattgcatcagtgtagataaaatcgccactacttttgattggcagcttctaacgtaaatacgaattcacttaacgatttcaattaattacaggaaatgacaatgaaattagaaactctatccattcatgcgggttattcgccagatcctgccaccaaagcagttgccgttcccatctaccagacaacgtcttacgccttcgatgatacccagcatggggctgatctatttgatttaaaagttgaaggtaacatttactcccgcatgatgaacccaaccaatgatgtgttggaaaaacgcattgcggccttggaaggtggcattggtgcgctgtctgttgcttcaggtatggcagccgtcacctatgctatccaagccattgcccaagcgggagataacatcatttctgtggcaaaactgtatggtggaacctataacgtgatggcgcacactttcccaagcatagggattgagacccgtttcgttgatcacaacgatatcgcagccatcgaagcattgattgatgagaaaaccaaagcagtatattgcgaatccatcacaaaccccggtggccatatcattgatatccaagcaatggcagatgttgcccataaatatggtatcccgctgattgtcgataataccgtcgcaactccctacttatgccgtccgtttgaacatggtgcagatatcgttatccattctctgaccaaatatatcggcggtcatggcaccaccattggcggtattatcgtcgattcaggcaaattcccgtgggcagaacatcaagatcgttttgctattctcagcacaccggatgcgtcgtatcacggaattatttataccgaacattttggtgcagccgcctatatcgcccgctgccgtgttgggccactgcgcagtactggtgccacactttcggcattcagtgcgttcctgatcctgcaagggcttgaaacattagcgcttcgcatggaacgccatactgaaaataccttgaaagtcgcacaatacttgaatgagcatcctcaagtatcttgggttaaatacgccggattgcctgaacacccagagcatgaactggcggtacgttacatgggggggaaaccttcgtctgtgctgtcattcggtatcaaaggagaagaagaagctggcacacgtttcattgatgcactggaactgatcgtgcgtctggtcaacatcggcgatgccaaatctctggcctgccatccggcatcaaccacacaccgccagttaaacgatgcagaaatggtaaaagcaggggtatcacgagatttgattcgtctttccattggaatagagcacagcgatgatattattgccgatctttcacaggcgttagatgccgcaaaatagtcattaatttattattcaaagaaataataaaacaccggtatcaacagatattgataccggtgaaattatgaaaaatataaaatcagattttaccgatattagataaaaagttagaataccgttccatatcaatatttccaccgctaagaataatcccgattcgttgcccttttaactcttctcgcatttttcttgcagcagagaaccctaaacaccctgtaggttcaacaactgttttcattcgttctgctaaaaagtacatagcatcaatcaattcatcatctgaagtaactagaatatcttcaaccagatgacgaataataggaaaagtgtattttcctagatgctgtgtttgtgctccatccgcaatggtttttggtgttgcaatatgaacaatttcaccttttttaaaagattgctgaccatcattacctgctacaggctctactccaaaaatccgacattttggagaaaaatgaacagcagaaagtgcagaacctgataataatcctccaccaccaagaggaatgaacaaggcatctaattctcccacttcttcaaacaattctttagttgatgttccttgaccagcaatgatgtgtggatgatcgtaaggtggaataaacgttaaaccgtactgattcgctaaattacgagttatttcctcacaatcttcagtatatctatcataaattactactttaccaccataaccttttgtcgctgcaattttggccttcggagcatcctgtggcataacaatagtagcaggaatattgagtaaattagcagccaaagaaatagcttgagcatgatttccagacgaaaaagtaacgactcccgcttttttctgttcatcactaaattgatatagtgcattcatagctccacgaaatttgaatgctcccattctttggtaattttcacacttaaaatagacttcagcattgaagagttggttaacagtccttgacgtaaaaacaggggttttattgatatatttttttattcgggaatgcgcttctaccacatcatgataatctggaatgaaattcattttttaagctcctgaactgagaaaaatactttatatttttagcatgctggacttattactataattaattttatattttttataaagactcagtaaaatttcatcattttgttaatttaccctatctctgttatatacccattaatagctatttttagtgatttttcattatcaatcattaacacataaagcaaagtaatccacagatcaattatctcctatatttcatggtagagcccgtagtaaatatttatagttcaataatatattatttactattagaaataactcccacaaaatcttattaagatcatctctatacggcaaaaagtccacaacaaatttaattcataatactgattattaaattatactatattaacaatataaaataattcatctctttattaacacataagaaacatttgttcgttttacttatccattgtattttaattacgaacaattaaagcggtaactgtggctcagacacgctcaacaacacataggcaggcgacaatgctacatcgtttctttgaaactgctaaaaaccaacaaccggattgcctctcataacctgcttggtcaaccttttataccgctcaacacatccatgagagaaaatgttttaatgactcaaattcaatgctatctcaacaatacatactgtttcctctccactggagaagtcatcgccaatggttctgatgaatggggacagtggattgctctaaacaacaacatatttcatccacaaggcggggggcaacccgctgatattggctgggtaaataacatccccgtgaaggttagaaagcaggctacagggcaggtagtcgtgtatccggaatccgcacttcatgccccaccaggtgcacaattgaactcaaaactatcagaagaggctcgtatatgtcatgcagcgctacacactgctggtcacctgctgaactgggaaatgcgtcaatatggctggatggcaatcaaaggccaccactttcccggagaatcacgcgttgagttctctcctatgggctccagtgccataccctccgatcaactatctttacaaaatatcgaaacaactatcaacactagactgcgtgatggcgggcaagtaacaacttggtatgaagcggatacccggctgtgtttaattgaaggtactgaacccatgccctgtgcaggcacacatgttgataatctgaataaaatcaatgaatttactattaagtcggtcaagttcaaaaaggaaactctacgtatcagctacgacgccagccatattattttaaggactgacaatgtctcatgatgcattacccttatcccgtaggcgtctctatctgctggatctgggactactggctgttgccctttcttggggcgccagctattcgctgatgcaattgatcattcaagccggagtgactataccgttatttttgatgctgcgctttgctctggccgtaccttttatgttttttggcactcgaatacgcctgcataacatcaaacccggagaaattattaatggcctgatattcggctgcctgctgtacgccatcctgacgtttgaaaccttgggagtaaagtacactacagcgtctaatgctgggttccttattgccttgtctgtcgtcatcgtccccttttttgaacgtatattgggcaaacgtaagcaaagtaagtttatttactttacctgttttatttctttagtcggcggtgggatattaagtttttccaatacagacaactttggctttaataacggtgactggttgatcctgcttgcagcgctgattcgcggtttccaaatctttatgtttggtaagcagacatccggtaaatcctactcattagttaatatcaccctgattgaactggtgacagtctccgtacttggattagcctttgttttaatgactgattcagcatcattgctcctcattccaaccatcacattcaatgtttggggatatattctgtttctgagtttgctcgcaactgcttttgcttttctgatgcagctttatgcagcaaacatcaccagccctactcgggttggcctgatcttgtcattggagcccgggtttgcagccctgtttgctgtcacaattatgggagaaactatcggtattttgcagggcttcggcggagccattattgtctgtgccgctctgctaggacgtatcgtggaaggaaaacgctatgagtaatcaaccttctcatatagatagtgagcagagataattatgttgacatgatgggggcaatctttcccccatcattattaactttgaattgaataagacatgactactgttgcactaacggcaacatcaatacatatataggaatgtatgacatcaccagagaatgcataaaagtcaccgggatttaatatcacactttcatcgtttgaaagtcgtaacattaatacaccatcatgaatcataatgtgttcatgagtccctactgtatgagcgggactactaataataacccctggattcatttgtaaatgccatatttcagcaacactccccaagccgatacgaaacttcatcacttgggaatatgtatccttcattggaatctttttttccagataggggtagcgctcattattgctgccaaataaatctcccagcggaagacgtagcgcaattgcaatagcatctaacgtatcaattcgaggattagagttgcccgactccaattgagatagtgcggccttggatacaccagacaacttagagtgtatcccaataggagatatttgatattatagtcagcctgtttttttacatttaggggattttttcatgaataagaaatcaatagcccaatggttcatttctgatgaactctggcagaaaattgaacccttactccctccacataaaacccatcaccctttgggctgccatcgccgccgtgtcgataatcgggccgctatgaatgctatcttttttgtgttacgaaccggatgccagtggaatgccctcaatgccacagggatttgttcttcaagcagtgctcaccgccgttttcaggaatgggtggcgggaggcgtctttgagcgactctggcaaaatggcttactcgccagtgaaaaaataggggctatcgactggggcaaattggcactggatggctgtttgactaaagcgcccctggccggctcaaaaaaacaggccgcaacccaacagaccggggaaaacaaggcgtaaagcgaagtttgctcacggatggacagggcttgccattagcgattgccgttgcgcccgctaatattcatgatatcagacttgttatagccaccctggacggtttacagacaggacgccggggttatggaaccaaactccatcgggataaagcttatgaggcggaatggctggaaaaagaattaaaaacccgtggatacgtcccctgcatacaatcaagaaaagaagaacaagatgcgctggccgaacaagaggattttaaagtgaaccgttgggttgttgaaaggacacacagttggcttaatcgttttcgtcggattctggtccgttgggaaaaacgggttgaaaattatgaagccatgcttcatttggcttgtagtttaattgtctggaatataatcctattgggataggctcttagacagttcgtttaaagaaatatttctagctaaacgcaatcgttttaccttgttaccaatatctatacaatttttcttaactctatcttgttgttgagtattattcataaccaaatcaattttttattaagaataaataaagactaacagaaatagatgaaaacatcttcaaaaataaataattaacacactcaaagtttttttatatttgctgtttttattatcccaacacctgcatttctcaatcaccaaaattattctttttacatattaagaatacagttttttatttcaaaaattattttattaaaaaatgaaacaccaatgacaataaaacgacaaaataaccaaaaaaacagataaattataaacaaataaacctattattcatattatgcaaaggccggtaaaaaccagcctttgcattttcaatcagatatcaagctttgaacgtgatccacggcctgacccttgcaacgggctgaattaatccagcctgttcttgaatctcaattaccggcgtaattggcttataagcctcaggcgcttcttcacgcaggcgatcacttttcaaagtgatgcactgccacggcaatcgactatttttttgtagatcaggcactttattccgcattgcctgacggcgtatcgaacgcccggctccgtgtgaacacgaccacagccagtcttcattgcctttccccaatacaaggtaagaataatcccccattgagccgggaattaacgccaattccccagctcgtgcaggtgtggcacctttgcgatggaggttcataccctgctcaggaaagataatattatgcgagagatccacaatcagcttacttttatcctgcccaaaaatctgtttccaagccgcgcgcaccagttccgtcaaaacaatgcgattcgcccacgcataacgcgccgcacagcccatcgccagaaaatattcctgagcgtgttcatctgtcagaccaaacaggccagaagatggatattttgccgtaaccggccataaagctctcgctttatccacccaacgctgaccgatgtaaaagcccacatcccgtgaaccagtgtggatcatcatcaatacctcaccttcatgcagacctgccgcgtatgccgcgtgcctgtccagaatagtatcgacgatttgcagttcaacaaagtggttgcctgaacccactgtacccaagctggctggacggataatttcacggtgctcgaaaaaggcttcaggtgcgtatcggctatgcgcctgtactgcctgagtactcagtatcgcgtttaattcagtatgcatgcgcttgaaatcggcctgttgccagaccccctgttggggcaattcctgtaaccatgccgccagcccttcgtcaaacaaggcactgaatgaggttggagtgacgggtacatcacgttgatccatcaatagggtattttttagctgctgaatcaaggcttctttttggctattcgcttctgcatagctcaaacccgttgtcagcaggcgcataccgcagttgatgtctgtcccaatagcagcagggatcaccagatcctctgtcgttgccacaatacagcccactggcgccaccgctcccggatgaaaatccggtgtcgctctggtacgacacactttcgcgtcgctaccgggtacgtgaacggaagcaaggtcaagtaattgctgtacggccttttcttccaacggcaaggattcaggcagtagaacttcagcttcaatctgctctttattgaaacgatagatattattttcgtactgggtttcgattccctgacgggataaacgtttttgtaaacgagtaaacgtagacatgttggctacctagaaaaacaaaaaattgcttcttccgttttcatggggaagaagtgttgtttttcctgcagcagctcaattcaggaagattttagcggcgttactctatccatgaattctgagattgtaaaggcctttctgataccgacaaaaaatcaccgtaacccccccaaattatgtatttcgtttaataaggtaaattaccaccagaatgactctagcagacagattcacattttatttaatggttgaatcgtatgtgttgattaagcagaaacaggctcagaattaatgggtgttttttaatatcttgaattaacgagattagatcgcttaaaattcaaataaatttaatgaataatgttaacattattttattattagtgttaaatacaattcgggattaaaataggtagggaaaatgaaaaggttttttttagtgtttgtacttacgttatttttgtcaggttgtggtgatgctgacgaaggttattatcttatcaaaaatattgacgtcatttttgatgaagacgaagggcttgaggatttcaaggaattaattgcaaagaaaatcaaaggagaaaaagattatatgtatttttttctgactcctgatgaggccagctactttaccggtgttaaaccagaaaaaacagcgatcaaggataacaggcttgagattggccatgacatgcttactctgaaaaacacgttttcaggtgtcaaactagttggtgataaaaagagaatctgtggtttttacaattgtataattacctttgaattagataaagttaaacaaaatgataaaagacttcttgatatacaaaataaattcaaagagtcagaaattaaaaaacaaaaattatatgctgcacagaaagaaaaactggctgaacttgtttttaaggatttctttggtcagttaacctatttagacgattttagtattaaactcgagccgatagaatcaggctctttaaatgaaattaattctggtatatattttcgtaacatgggtggattacgtattgatttggagagtgaagataatacaatttataatttcaaaaatcaaaacagtcaacttattggtgaattatttattattaaatccctcaaagataaattcgattattcatcatggttagagatacaagatgaaatattatatcaagataaacagggcgctatttactacaatatgcacggtgaactggaagcagtttattatcaatacgatgaaaaatcccaacattattttatcggtcttgctaacgcacctaaattagaaaccataaaaaaatcctatattatgctacgtactatggatgagcagtaccgaggagaaatcgccaatatacaggatgtttctctatctcaaactgactttgaaaacaaatacggaataaaaatatccgatagttttgacagtcaagaaatccataaggttcttatcaaaaaaatgaatgataagttggctgaaactaaagatttttccaaagataaagattggttcaattccatattggtaaggtttccatcagaatcatttagctccaaaatttatttttattttcatccaaaacctatgaaaaaagttatttctgaatttaagaataaataccctagaggaaaatggattgagaatgtttttgtttacaatatttctccatcttccgaaagcggctatagttattttattaaccataatggtatggtttatgagatatttgtggccactgatattcatagcaccgtcgaacgaatggctttcctcagcgtattacgtcatttagatcctactaagctgcaagggtactcaccttcaaagctgcgaccttaaggcaaactgatagtattatcatctggtcttaataccggaacaagatgatgacgcatgggtattgataaaaccttatttgcctcctgcccattcagagcgggcaggacgtctacatgttgaacaccttgccctctccccgttttgcgagcatgatcgcaatacctttacccgttagtcagaaagcccacatgcttacgatcaagaaactgcaaaccgctatctcaagcctttcggtatggcgcaaggggggatcaacgtgcgccacataagccattattactgctgtatgtactttctcaataccaaaaaaagcatgggcgactgtttaactacggggaagaaatccaccagccattactggagttactcaacaattttgggccaaagcgcaaaaaccattatccaaccatgccattctggcggttacgcggcgatgggttctgggagttgcagaataccgaacgctgcacaccccaaaaaggcaataaagaaccaccaaagcgcgagttgattgaatatggcgtgataggaggattcgatatgggttcaattggtcttgacgatagtatgaagttaatcgtttcaaaaggtattaatggcggccagatggtggagcagcttttctggaattttgccgatcagccaatcttgctccctcagcaaaaagaatattacccgctggaagagttcgtcatttggcatcgcagccaagtctttaagcaacaatccgcacagattaaaaaggggagccacccgctcctctgctattcagactgttgcaggttattgacccgctttcagtttctggaaatagttttcgtacaggatattggcgttgccaacatcgctctgccattcccctttctggataatggcttcatcaggatacagtgacgggtctcccgtgatttctgccggcagtaattttttcgctgccagattcggcgtcggataaccgattttttgtgcaacctgtgccgcgatctctggacgtaacaggaagttaatcagcttcatcgccccatcaacattcttggcattggcagggatcgccagactatccatccagaaaattccgccttccttcggccagataatatcaaccggtgttcccgactggcgtgctacataggcagagcctgtccacaccatacctaaatcaacttcaccttccataaatggattggctgggttatcagagttgaatgccagtacgtttggcatcagtttttgcagttcctgataagccgcttcaatctctttcggattggtcgtattgccggaatagcccagcttcagcaatgccatctggaagacttcacgagcatcatcagtcagcaccagaccgctttgatactgaggcttccaaaaatcggcccaagagctgatggtttttggatcgatattatcgctgttgacaccaatgaccgtcgctccccaaatataggggatagaatattcgttattctggtcaaaagacttatgcagcagattcggatcaagatttttgaaattgctgagtttgctcgtatcaatcttttgcagcatcccctctttactcatttttgagacaaagtaagtggatggcacaactaaatcataagcgccgtctttataggttttcagcttggtatacatgctctcattggattcataggtggagtaaatcaccttaatcccagtttcgttggtgaactggttgagcaaaccaggcggaacgtattcagtccagttgtagaaatacagcgttttgccatcatcagcggcagcggcattcaccgaaccaatgctaaatgccatcatcccagcggctagcagatagaaccactttttcatgcagtgtttccctcacagttggtgcgttagtcatgtataggcccagagtgaacctatcctttgaaaagcggctattatagaagcgacatttcatggggtaaagccaattatcccgtgttttattggcgttttggcaagaaattctgatttttcagggtaaaaagcgatgttacaaataaagtgaagacgtggccagcttgtgaccacgcccaaatcaacgttaagctttgccagtacgatcacgcataataaactggctgaacagcaccaatatcagtgacattaccagcaaaatagtcgctaatgcgttaacttccggcgaaacgcccacttttaccattgaataaatcttaaggggcaggatttcatagcttggccccgtcacgaatgaggaaacaaccacatcatccatcgacagggtaaaactgagcagccaacctgccatcactgccggcatcgccagtggcaggataattttacgcagaatggtcaactcacccgcccctaaatcccgcgccgcttccagcattttgacgtcaaaatctttcagacgagaataaaccgtcacaaccacaaatggcagacagaacgtgatatgcgaaaacagcagtgaccagaatcccagtgaaacgcccagcagcataaacagcaccagcaatgaaatcgccatgacaatatccggcgacatcatcaccacgaacaacataccgctcacgaactttttgccacggaacgaataacggtacaaggcaaccgccgtcagtgaaccaatcagagtggcaaatgtggcggaagtgaccgccatcgtcagggagtgtcccgccgcttgaagcaagctgtcattgttgaacagcaggttataccattcagtggtaaaaccctgccagctaataccgaaccgtgactggttaaacgaactgacgatcaggatcacgatcgggatatacaaataagcataaacgagggtcatgaaaccaccacgcaacaggcgtccgatcattccagttccaccttcttgttcagcaggttaggcgcacgataggtaaaccagcagcatcagccccatcaccagcgtcaggcatatgctggttaccgccccaaacggccagtcgcgaatattaaggaactggctttttatcacgttaccgatcagcaggtttttcgccccgcccatcaggtcagccacgtagaacagccccattgccggcaacagtaccagcaggcaacccgcaataatacccggcatcgttaaagggataatgatgcggataaacgtctgcaattttcccgcccccagatcacgcgcggcttccagacagggtttatccaatttctcaatactggaatagagtggcattaccataaacggcagcaggatataaaccagccccagcacaacggcttcggaggtatacataatgcgcagcggtttatcgactattcccagccacagcaggaaatcattaagataaccacgagtgctgaggaacatcttcaaaccataaatgcggattaaagagttcgtccaaaacgggacgatcaacaagaacagcatcagcggacgcagcttctccggcatccgagccaagaaaaaggcgaacgggtagccgatcaccagacagcataacgtcgcgacgatagccatattcagcgagtgtagcaagacttcggcatacagcggatcgaacaggcgggaatagttgtccagcgaaaataccatctgtaccagattggcgtcatcgcgggtcagaaagctggttccgatgatcatcaggttcggcataaagacgaacagcatcagccaagacaccatgcccgtgatgacgatattctggaataatttacgcgtcttcttcatcgaccagcacaacctcccagctttctacccaagtgaccgcgatcttctggttcagggagtggtcaacatcggggtcgtcttcgttaaagaattcgctcaccatgaccattttgccattttccatttcgaccaccgaatccagcgtcatgcccttgtagttacgttcacgcacataaccaaccagacccgacacctgctcgccatgattgatctcttcgacccgaagatcttctgggcgcagcaacactttcagtatttgtccggcggtgacgggcaacgaagtgaaaatatcacattcgtggccttcgacgtcagcgcgtatccgctgctcatcaatgcgatgctgcaccttggcatcaaagatattgatttcgccgataaagcgggcaacgaacagatttttcggctcctcgtagatctcacgcggcgtgccatcctgttcgatgtacccatcacgcatgaccacgatccggtctgacatcaccagcgcttcttcctgatcatgggtcacgaagataaaagtgatgccgagcttgcgctgaagtgctttcaactcattttgcatctgcttacgcagcttatagtcgagtgccgacagcgattcatccagcagcaagactttcggcttgttcacaaccgcacgggcaatcgccacgcgctgctgctgaccgccagaaagctgagccggacgccgctgggcaaactcttcaagctgcaccatgcgcaacgcttcttcaacacgcggggcaatctcctttgccggtgttttctgcatgcgcaatccaaaagcgacgttttcaaatacggtcatatgggggaacagcgcgtaactttggaacaccgtattaacgtgacggtgctcggcgggaatatcagtaatatcctgcccttccaataaaattttgccgctatccgcatcttccagcccggcaatcagacggagtacagtggtcttgccgcaaccggatggcccaagaatggtcaggaactcgccatcattgataatcagatcgagctgtgaaataacttgtttgccgtcgaaacccttactcagggtgtttagttcaacgagtggtgtcagagaggtattctcagtcatttatgctatcatctatcccttggaataatgcagatagaaccgccacgggaaaagactgtgtcagccagcaggaaaaatcgtttctccgctgaagctcaaaccagtagcgccggttgaaattacgaagcgcgcataataaacgcagtaagctgaaattgaaagccgaaacaataacaatatgtcattttttgttatcatttcataaatgataacatcgcactccatgttgtacccagtctacacgcctggaaataatttcctatcgggcattttacaatcacttttaattttctttactttcaataagatccttcagacacgaaaacccgctcttccctccattaaaactcacttgaaaacaccgtttatgctactctgccacacttccggcgttatacaggccctgctatcttttctttccccctcgacaaaaacgcgccatccgattcttttttgaaattaataaaatttaaataagtaagatcgctatcaccctctaggaaaataatccggatcccctactttacaccctaactttttggcgatacgtgcgcattgttgtcgataatcagcattgactatctgcacaaataaaaacaattaaataaccctattcaggtaatcaggatcgcatcatctcctcacctccaaaaggtgagttcatttgaacattgatgcgatattaagagaatgaatagagattattttagagcgtgaaataccgtcctcaacctatcttggtaacggcattgccattccacatgggacaacagcaactcgttggagtattgatgaccatcgccaccaacacggcccttcctttgtcacagacgtgaacaacgcagagctggtgattatcatcggcaattctgcgcctgataacgcggtgcagcacaacacaatgaacatcgtggcgctcaccagcacttaatgaccggcgtttcctacatactgccgatggtcgtcgcggggggtgtgcatctccctgtcatttgtcttcggcatagaagaatttaaagaatccggcacactggccgcagccctgatgcaaatcggcgccagctccgcactttcgctaatggtgccagtgctctccggttacccctctctgtcagcatagttgtcacccccactaacaacgctgatagagaggggggttgctgcaagagctgagtactgttgatttacttgtaattgatgagataggcatgcagatagagtcacgctatgaaaaagtgactatcaatcagatagtagatcgtcgttcatcatcaaagcgtcccactggtatgttgtcaaatcttgacatgaatggtatgaatactctacttggtgaaagggtaatggatcgtatgcgtcttggtgatagcctatgggttatatttaattggggcagttatcgtagtcgtattaaaggaaatgaatactgagtgaatatccgctttgattagagctaatgccgatacgttatttatataaatgactaaaataacccctgattacaggggcttacaatttatttatcactttcagtttcatctttgatgactggttctgtcaattttggtacattgttgtataaatcatctggattaatattagtaatatgctcgataatcctttcagaggatagaactggctgttttttgcctctagggtacgcttttcctagaaatttatcgctttcaacccagtcaatatttttattaatactgctaattaaagtattgcaggtgtgtctattgctttgtgtatatttaatggcatgttgtcctgcggaatacctaacagatgaacttgctatataagagagatcttttgcactcaaacacgtagtcgagagtctttcaatagttttttcattgagcatgaactcatttgaccaactatctcttatatttcctaaataatactccattgcgtcatgaaaatatccagtagaaatttccttccacatttcaaaggacgcatcaaatttatcttttcttctatctatctcctctaggaatatcttaatggagatctttctattatcaataatccctataacatttaaatggaacttaaaattattaacaatatggtcaaaatcattgagtaatttgttttcaatgttatcaaaatcctgttgagttagagttattattcctttgacagctagcgacttaaacatctcagttgtcaatatttttgatggaaaaatgtaactacctgatcgatagagttctttaaaaccccaatcatcaccacaaccatcaagaaatgaacaaattgatataagatcaagcgtttcaatttcgttaatgttttttattttaatattcttcggatttaatgggtgtttttttcttgcattttgttttttatctatttctgtgacgatcgatataattctattctttttatcatcatcatcgatataatccagccagtgttctgcttcactgatatctccaatttttgttgcagttaaagctgtgttatatgccaaagattgagtatacacactattttctaatgaaatgttatccgcatcaaagaaagtatttgctatatctatagcataacgggggtttatatctgtattaaaatatgacataaagaaaagcacactttgactagatttttcttttgcaactgcatagataagtttcgtcatcttttcaagaatagctagccctgaagaggtgttgactaagaatctatgtgttgcttcatagaaattaagcaagatatcaatagataaagtatcaacggcagggaatggcggtatctcaccatattttggagaacgtcccagaaaacaattaaagtaagaatttatctgctgcttagtgcctgagaggataaaagtaataatagttctaatatatggatgtaaaatagatgttgatttatttatcccgagaaggaattgtgttttatctgtaagattcatatcatctattttattcaagagttcacttataagaataggttttttttctatgaagaatagtaaatgaagcaccgactgcctttcagttatatactctctattctctcttgctaaaatcgctttacttatataatagtcaggatgttctgttatctcattttcatccagaaattctataatactattgcacaccgataaaatatctccatttatttcaaatggataaatggattctttttttttgtatttttcctttttttgtttctcatcgactaagcctctgttttatgttgatctatgattacattaatcataggttattcatttgtgttttttatttgttttctgtaaattagacaaaactttattatagtattgtgattttactcacaaataatggacaccaaactaagcaaaattctatttctcaaatgattctcgactgagaccactgttagcgttgtgataacaccgacgattataatccccttctatatagtcaaaaactgtctgacacataaccattcgtatcgcgaagctttcaccatgtataaattcaacttctaacgaatggaaaaaactttctgcacggacgtgtattatcatatcagcaggctttagcactcatactgcaatgcaagtcataccttttatcaataatgcctaataatcctccgaccagtattgatttcctctgccagcgtacacaatcacatactttggcgtttatgtagccaaagcacataattagtgcatcacaggccagttgtaccttcattcaagaagacatgcctcactcaataaccaccctatcgataaccacggccagaacaaccagccttcacttgtgctcagctaggtgatattaccgccctatttctagtttagcactgtgacatggaaatcctgttgcatttgctgatactgttttgtcaagcgaatcacccttatgaatgatttgactcacttagcatcgtgtctactaatagtcgataaaatcgtcattctagaacagcctcttagtcatgaagaagtcattgaaacagcggaaaaagtaaaagcgacgtttcttaaactggtagtagaaaccatttctcgcttctgacttttcagccaaaatagatttcaagttacaaccaacaaaacagcaacttgaaagatgaggcgtatcgtaaaatcctacatagccactgcatcaaacgtgatagtggcgacaaattccacccccatcttatactaaatcctgaggtgacgcggagaatggagccgatcgttgaatagtcgcaatcgcttctttatccgctttcacaggatctggtttacgacaagatatcggctttcggatcaatcaacaatgagagcaattgcgctatcacgtagccgaccgaacgagacccgattgtctcccttggtacagtgcgccacgcgtctagtgagcaggctaaagcctattatcacgattagtatcagccacaacgtatgacattcgtagtgatcggcaagctcccgcggtaatatagcaagctcaggtggcaaataaggccacctgagtaccaacaaaaaacataagtgatgtaatatcaaacggagatcgattatgaaaaatacaacaacacctacgctggaaggtcataccatcacggaatatctgggtgtcgtcacaggggaaacgattcttggggtcaatattattaaggatttttttgctggggtgagagatatcatcggcggacgttctggcgcttatgagaaagaattgaaaaatgcacgggaaatcgccttcgcggaaatgaatgcacaagcccaagcgctaggagccaatgcggttgtcggtattgatattgactatgagacggttggtaaaaatggcggcatgttgatggtcactgtctcggggactgcggtgaagattgtgtaaggagggatagtaggcaggattttaggttccctaaactggtaataagccagagcatgtggcatccaaatattctttccaacaattattacatttcattttcctgcgcattaactgtaccctgccaccgacagagcataaccgcgaaggctgaaacgaatggacgaagccgtgcggatcgcaatggaagagtgaggtgcgttatcagtgttttgctgattataaatggataacttaagccgctaaaaagcggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttattcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccccgcaagggcaagtgctctggctatctaacgttccagccagtttagttcccatataaaaaaagcaattcacaccacctacgatagaaaaattacccgaatgatttccacaagtaacaagagatcctttcgttgcagcctgtcgcccataaaacgtgatgttactaggggctgttgacgttttatgaggagaatttgaacagcatgatgctctggtatcattgtcttcgcgaaaaaaccattaccccagaccatcatgccaagaacaatgttatcaaaacctttatggaataagctagctgtattgatgcaacaaagtggatatgtatatcacaaagaagaacattatctgactttcgagaggatcctttaccggatgcgaacaggctgtccctggcgagatgcccccactgaatttggcaaatggaacaccatttttaagcgctttaatgatgggtctaagaaagctatttttaatttattattcaaattattatctgagaatacagatacagaatggttgttcattgatggcagtattgttcgggctcatcaacatagttcaggtgccgcttctgtggaagatgaagccattggtaaaagtcggggaggactttctaccaaaattcatttagccgtcgatagttacggcttgcctgttcattttgaattatccgggggacaagtgcatgacattgttcatgcggaaagtttagtcgaacaatcgcccccttcggactttgtgatagcggacaaaggttacgacagcggtcattccttatagaaaaaatagccgtagagcagataaaaacattgatgactatttatactgtcaccggcatttggtggaaaatgcctttgccaaaattaaacatttccgggcaatagccacaagatacgataaattagcacgcaattatgccagtacgttagcactggcgtttaccattgtgtggctgcctatgtgggttgagtaaatgatgaactcaaaacgtcaacagcccctaatataattaataggcactccctttttacattcatcctcttaatctatgtagatccccagccatggcccctcctgaaggcctggtgcattccactagctggtcctcgccagcactaaagaaatttatcctatgcaaaacaaaaaacgatgggagccagactggtttctacagtcactcctgaacaaccatatcgacaaactggtagagcactattcctgcctgcgtgcattccgaacagatctattttaccaggatcataccgctaagtttttcctgcgagattatcggcaactcgaagcggtggtcggtttcttctgggttatcgaatggactgaagatcatcactaccatgcccatgtcgtgttctggctggatggtagcaaaactcagaacacatatccctgggctcagcaagccggtttgcaatggagcgatatcactgaccgggatggctggtatcaccgatgcgagtttaaagagcattacgaggccgatatcaatatcccggtacgttacagcgatccgggcagtatcgccaatatccgacaggtactggcgtatatgaccaaaattcagcagaaacatggcctgctgctgtacggctgcaatgaagtccccgggcgcccacgcagaattgatttctgagtatcacagtttttactccaacatctcatagagtgacaactacatagctatccccttcttaatccctttaagctattgaaccggatggcgtcagtctacccttttggggatgactaacgccgttctactgacgtctgattatgtttgctgaacctttatcgctcccaatgataatgatcggtgccagaacgacccagacatctcacttgcgaggaaaaactcagtgagtgaatattgattatctatgagatatttgtatcggcctaaaacagacgattaacgagcggttggaaatgcatgcaaaagcaagcaacagataataaatttaaccaaggaattagatatggcatccgcgttaggttggcttgatcacgatgcagacacacaggctaaaacgttaaatattcttgcgctctttcaacaaaaagagagccgtgatgaattgggtattggctcgatccgagatagttttgctgaacagttatttccaggaaccagcaccatccagacccgtttacgctacatgctttttgttccatggatctatctgcgcctcgagaataaacgcatacccgccgcaaactttggtactcaggccgaccgtgacgaacgcgccttaattatcacactctcccggctcgaagattcggccggtacatttggtaaaaactcacgcgagaagcttaaacgcttgcccagctccgtttactggtccgggctgcggcgctggggtattcgcgagactatgtggtcgcaggaagaatatcatcggcgtgtggatgaattgtatcgcgaacgtacggaaatcagcgagcgagaataccttgaaaaaaatcggggtgatatgggcgacacaagcgcgtataaaccagcccagagctggcactccagcctgcctgcgccaccgcccaactttcctaatgatgcaacgtttgcactaacacgccaggaagccagctttcttcgcgatcgtattcaattgtcatgcaaaggcagtctgttggcctggctgacgctgcatagcgaaccggcagatgtgagttcaccatgggaacaccctgattacgcgaggttcccagatgaactcaaggaactgctgactcacgcgcggcttttttcttatacgatgcacggtgcagccctgctttataactatttgctcgccaaagagcgttcagataacgaccttctgtctcaacacaataacaacttcgtcgactggtttactgcactcccacgtaaggaaatcgctacctggtcgctcggccgcatgtgggaactcaccgccgaaccgggctatagcattagcctaaaaacccgccgctttgtggaacagtggattgctcttatccaacagtcccctgtgacattactcaccagtaaagaagcttgtgatctaatccgtgctcgcgaaataaccctcaaaggcccacgttcgcgcttcaaaaacagacgctctctggagcaatggagtggctatgccggaaccctgcggctggtttaccgctggcataacgtccaaatagttcttaaggatctggcgcacggcctcaggagagaagaatgctaaatcccaacaatcgcagcttatatacttcggcactgacttctcctcccggtatggtgtttgacgaagccatagctacaagcttctcactcgacccggcatttttactgcaggcaccggtctatttggctttcacagcaaccgacagcaatcgcgctcaggatccgctatccatttttgaagccattcgtcgttattccgaacgtatcacggtatacgttcaaaaaggccgcattcaagttcccacaaagctcaagcccaaccctttgttcgggttgcttgaagatatgattgttgaatcaaaagccaaaggccgcggggtctttcaccccaaaatctgggcgattcgttttatcaatcctgaaacagacgaagtcatgtatcggttggtagtactgagccgaaatttaaccactgattcgtcctgggacctctctttgcagttggacggctaccctgtaaaacgtaagcaaagtgccaataaagcactggtgcatttattctccgtattgcccaaacgggcgacgggaaaaatggcgaaacatcgccggaagcaggcgcagcgcttcgcagatgaactgttgtatattgaatgggaatgtcccgctggttttgataaagtcgcgtttttcctgcccggagaaggttacgaatggaagccacccgaagcggatcgtgcggtggttatatcaccgttttgcaccgatgaggccctgcgccacatcgtggaacattgccaacaagctgatgccctgatttcaagacctgacaccctgctcgccttgagtaaaaagacgctcaaccttttcacgcgccagcttcatcttgacgacgcagccgaagggcagatgcacgacgagagctcacctgatgagatcattgcctccggtctgcatgccaaagcgtatctatttgaaaatggccgagacagcgaactggttctgggctcagcgaacgccaccagcgcggcgctactggggaaaacaaactgcgaaattttagtctcgctcaagggtaagaaaaagcacacgggcactattgatgacctccttagcagcgacgggatgggaagctatctgcaagatttcgaccctgcccagccgtttgagcccgatgccctgcgtgtcaaagcagaatgccatcttgaacaggcgcgtacgttgcttgctgaagctacattgagtcttcatggtcaccccggtcaaaacgaccaaagctgggcattgtggcttattggcgagattcctaagttaccgggagttgtgcaggcaacagcatggcccataacggtatcagaagtgttaagctgcaatctacaggacccgaataaggagaataaaagagaactcggagagttttcagtccaagcaattaccggactgacagcgttttcccttaaaacatcgcacccagacgtatcgctcaggttcgttctcaatctgccaattgattccttaccccccgatcacaacgcaatgattttacaaagcagcatgcggaatcaggattttctacgttacttgttgatgttgataggtgaaacggggcatcaatccttctttgccgaaaataccttcggtgatggtcatttctttacagggctagccaatggagaggaattcagcgttctggaagagctgacacgtatctatagccgcgaacccgaacgtttaaacgatatcgccgcgctggtggaaaatatgcgaaaagggaagaacgacatgattccgcaagattttcttgctctgtgggccgtatttgaatcagccatgggaggacgatatggccgataagcatcccagtattatcgccccactaacgggattgaaagattttcagcaacgcactgtgaattatgtttttcagcaattttacggtgatagacagcaaaatcgctttttggtagctgatgaagtgggtctgggaaaaacgatggttgctcggggcatcatcgccaaaacaatcgaacatttgcaggataaagtcgaccgtatcgacattatttatatctgttcaaatgcggccatcgcaacgcagaatatcaagcgcctaaacgtcagcaatgaaacgcagttttcacactcaacgcgactgacattcctaccaaaacaggtacggtctctgcgcaaaaacagaattaattttatcagcctgacgccgaacaccgcccttgatcacacccgcagccgtggaggtcataaagaagagcgcgcgatcctgtatcgcattttgtacgatttaccgctggctaaaggcgagcgtcgtgaacgtttacgcatggggatgcttaacctgctccaggcaacagctagccgacatggctggtgttccgcagttgaccagctttctgtcgacgacattgacagggaactagcaaaggattttcgtcgcaaggtgttagacgatgccgaactgtatgatctgctgaaggaggggtgcgaatatttcgccgatgacgatgaggacagcgagacgcacaattctgaactgcgctacgcactgatcggcaaactcagaagcaaactggcttctgtgtgcttatctgcgctggaacccgatctggttatccttgatgagtttcagcgatttaaagccttgctagatggtgatgatgaagctgcattgctggcaaaggcactctttgaacagccggacgtacgcgtgctcttactctcggcgaccccgtataaaatgtttaccctcgaccaggaaagcgaagaggataatcattacgccgactttatccgtacattgcagtttttgtataacgatgacagtcaaatcaaagatattcagcagcacttgctcgatcaccgtaccgcgttgcacacctcagaaaacgcagcggagacaaaaaatgcacttgagcacgctttattacaggttatgtgccgtaccgaacgggtaacgatgacacaaaagctagatgcgatgacgaaggaagtcttgcaaccagcaatcattacgcccaccgacctttatcacgctgcggccgttgatggcgtagccatggaagtgcaagctcgcgatatcctcgaatactggaaatcgatgccttatcttttcaatttcctaaaacattacgaattacgtacccttatagataaggcactgaaatctccttcagatacgttgcgtaaactcgttaaatcagcaaaacctcacttgctgacgaaaaaaaagcgggaacactaccagccattagatgctgcaaatccacgaatgcggatgctgtttgaagatacgctggataaaggtatgtggcagcttttgtggatgccaccttcactgccttacacaacaccaaatggggtgtatgccaacaaagagagtctgaccaaaacgctggtcttttccgcctggagcgcagtacctaatgcgattgccactgtctgctcttatgaagctgaacgacgaatggttggtgctgctcccctgattctacacagccagttcaaaaaaaaagtaaaatcgctactcaattttgcaaaatcatcgaaagatggccgcctcaccggaatgcccgttatagcctggatgctaccgtcaccaacacttgcccgccatatcgatccgcttgaaattgctcgccaaaaccccggtgagccgctgagtgtaaaggccgtgagagcaattgcaacggtgaaatgtgaagcgctgcttgagacactgcccaatggcggaccggggtctcgtgcggacgaacgctggtactgggcagccccggcgttgctggatgcccgtaccgaaacgccagactggtggctgggcgaacatggctggtataccgggccatcccaaaatgaccctgccgaaaacttccaggaacatatcgaccagtttgccgaggtggcaaatggtaagatatccctcggcccacgtcctgacgatctggcagaggttctctgtgacttcgcgcttgccagccccggaacatgtgccctccgggcgctcagccgtatcgacacaggcctggcaaccgattcggctgagatattgtccgcagcagcgcagatcgcttcaggatttcgttcgctctacaaccaggcagagagtatttcgctactacgcggctcaggcgatgacacttactggcggctgacgctgcgttatggcatcgatggcaacattcaggccatgctggatgagtatgttcatacactgctggagtcgatggggttgcagcatgaacccgccgaagcgcaactggcggctattgcaccccgtattcaggctgtggtttcactgcgtaccacgcaattgaacgttgatgagctcaagacgaaaggcggtaattatacttggagcgatttgtacacacgctgccgctttgccttacgctacggccaactgcgggacgacacggatcaggccgtcgcgcatgcagagtcggtaaaagatgcgtttaactccccctttcacccctttgtattggcttccacttcaatcgggcaagagggactcgattttcacacctggtgccacgcggtgatgcactggaatcttccgtcaaacccagtcgatatggagcagcgtgaaggacgagtacatcgttataagggccatgcggtaaggaagaatattgccgagcattatggtttgagtgcacttcattcgctggcagaaagtgcagatccatggacacagctcttcgcacttgcggcaagtcagcgcaaagcgggacagtcggatttgattccctactggatttttgaagaaggaacctctcgcgtcgagcgccgggttcccatactgccgtacagcaaagagagcattaagtttaagcggctcaagcgagaacttgcactctaccgtattgtcttcggccagccgcgccaggaagacttgctgttcggcctgaaacacattggcgatgagtctttaacggatttagcacagtggctcatttctcttgaaccaccaaaggtgtgatccactgaggacatcggatgatgcaatttgttcagttagcaagttaagagccaattctgttgcaaccagttctcttggattatccgtatgttggatttttccctgaatatttcgctctaggttatctaaatcggtattaccggcactctgtagtgtgataaaatcatgcccacatacttccgttttcgtgtcataacccatcactcgcagagccttgttcaccgtattctcactcatgggtttacgcggatcgtgatcgcctacaaaaatcagctctcgattcccattcatgcttttaatcttttccaaaattgctagagcctgttgcgacaagggaacaagatgaggagtccgcatcttcgaaccacgttgagaatgcttaacaccttcaagtggttcacgctcacctggaatcgtccacatagccttttcaaaatccacttctgaccagcgggcaaaacgcagctcgcttgaacggatgaaaaccaacaaagtgagttcaactgccagtcgagttaacggcctgccagaatagtgatcgatgtggtgaagtaattcaggaatgcgattaagttccagagcagcacgatgctgtcttttcgctgtagcaaccgcaccggcaatctcttgcgcagggttatagtcgattaagccgctctgaacggcaaagcgcataatcgcggtagtacgctgctgtaaacgggcggcgacttcaaggcgtccggatgactcgactgctttgatgggtacaagtaggtctcgcgttttcagttctgcaatgttccgcttaccgatagcagcgaagatattatcttcgagacttttcaatacacgagcgctatgcgatgccgaccatttctgattgctggcgtgccagtctctggcaaccacttcaaacgttacccgcagttgtacccgcatcagtaagttgatgtagattgaatcaggttgacttatgttgaatggaaaagcgggaagagctttacggggactggatttcagacgtaaaaaaagacgctttttagcgtcttaatttatatggtgccgaaggccggactcgaaccggcacacccgaaggcggttgattttgaatcaactgcgtctaccgatttcgccacttcggcactgaagtattcgagaagtactcggaaaacggaggtcattatacctgtcagaagtccattcgcaacacttatcctttcaatcttgttcaagtgtcgaaaaaaaaagcatatctaatcctttcccattaaaaacgctcaaaacccgaccatcttcctttcaagcagcacaaatcattcgcccacaatccccgtctaccaatagacaacctttaaacaccttatataattccacaacaacataccgctctgaggtaaacaatcatgtctattatcggctatatttttataggtatccttgtgggtatcattattggcgctgtcatcgcgctgtttaagaaaaagaaataacaatgttgttccaattaaacgctccctgattggttaatccaaaaaatgaacaaacagttatataaactttttgctgtttcagccctgtcatgggcgctttcggcttgtgctgcccccgataatgcacaccagaataattttccgcaatcaggcaaaaaaaccacaaaatggcaagtttttgagggtaatgataataccaagaaaatggcctcatctctggtcgaccagtatgcacagtcaatctttgatgaaggtaatccgttggggatggcaatggtgattatcgataataatcaggtggtgcatcgcagtttcggggagacttatccggggagtggagcccgtccgcgacaggattcggtgatccgccttgcttcgataacgaaactgatgaccagcgaggtcatgattaagctggcgcagaaggaacgcctcaagatcaccgatccgttgcagaaatacacttatcatggtgtgcgtgtacccgattatgcgataactcaaccgatccgcctgtatcatctggccagccataccagcggcctgccacgagagcagccgggcggaaaatgggggcggccggtgtttatctggccaacacaatcaaatcgctgggcttggctgaaaacagcaggtatgaatgccgctcccggtacaacggcttcgtattccaatctggcttacgatttactggcggatgcgctctctaaagccacgggggaaccctatacccggctgctacaagaagagatcacccgcccttatcgcatgaaggatacgacactgacaccctctcgttcccaatgtgctcgtttaatggaaggggttaagcccagtccctgtctcagtaccatcgccgcagcaggcagtggcgggatttattcgactcccgtagatatgcagcgctggatgcagcagtttttatcctcccacaatcaattgaggaagaagaccgccagccgtgagcagggtatctattttaaacgtgaaaatctgacgtcaatcacaggaatggatgtcgcgggtcaagcagacgggatcgggcttggctgggtatatatggatgccaaaaaaggggtgccgggcatctatcagaaaaccggcggcggcggcgggttcaatacctatatggcgatgatccctgagcaaaatatcggtgtgtttgtggtgatgacgcgcaaggaacaaagcaagttcagtcgtgtcactaacggggtgaatgaattggtcgcagcactgtcacgaaatcatggaaagttatagttctgtcgtgagtatcgtgtgttagaggaatgttcttgaaaaatcacagcctgagatttgtaagtgtaaagctcaggctgtgatttgtgatgaacgttattttcgatgcagaaggaagtaaacactcactacaaagaataacagactcggtagcagcgctcccaatagcggtggcatgctgtaaaccaagctcaatgggccaaatatctcattcaagacataaaatatgaagcctgtactgatacccgcaatgaccctgactcccattgccacactgcgcagtggcccgaagataaaggaaagtgccatcagcatcatgaccgcaacagacagaggggcaaagactttcttccacatattgagctggtaacgaccggcatcttgttgcccctgcttcaggtaagtaatgtactgctgaagcccgcgaatggagagtgcatccggatcaagagcgactacgcccagtttttccggtgtcagcaagcttttccattcagcagaaatacgctgtgagcccgtgatccggccaatctgacgtaaatcagactcttcaacctgcgataatttccactgcctgttattttgatcatacaccgccgtagccgcatattttactgacagcagttttttgttgtcatcaaaatgatagatactgacgtctctcagggcattatccttgtctacactcttaatatagacaaaatcattaccatctttcgcccacatccctttggcagtggacatcagggagccaccaaacatcttctgggaacgatagttacgggcgatttgttccccctgtggagcgacccattcaccgatcaccattgtcagaaataccaacgggatcgcggttttcatgactgaacccgccacttgcaggcgagtaaaaccagaagcctgcataaccaccagttcactgcgtgttgccagcgcccccagacccaataaccctccaagcagcgccgccatcggaaagaagatttggatatctttaggaacactcaacagcgtatagatgccagcagcaaacgcgctatattccccctgcccaaccttgcgaagctgatcgacaaacttgatgatgccggaaagcgacaccagcgtgaacagcgtcatcaaaatggtttgcaggatagtccgcccaatatatctgtccagtaccccaaacatcaggccgctccttgattcttaaagcgagaacgcagtttgcgcatgggtacggtatcccacatattgagcgccagcgccaaggcaaaataggctccgttgaccaaccacatccagaatgcggggtcgagtttacccctgccgccattggagcgcagggaactttgcagcaggaagaaaatcaggtaaagcagcatagcaggcagcatactgagcacacgcccctgccgcgggttcacggcactcaatggaaccaccagcagcgccatgaccagcaccgacacaatcagggtcaggcgccagtgcagctctgcacgggaatcttcgtcacccttgtgccagagctgggagaatgtcttctgctcaactttatcgctatcaatatcagcggctttgtgcccaatcaccgcctgataatttttgaaatcggtaatgcggaagtcacgcatcagtgcagtgccttcataacgcaccccctgatggagtaccgcgacctgattaccattcggacgctcttccatatggccgccatccgcaatcaccacggaagggcgctgattattcaccggtcggagctgagcaaggaacacattctcaaagttattgcccttgacgtcaccgatatacagcaccatgttgccatcacgggaaggcttaaactgaccttccataatggccgcaagacttgggttagcttttgcatccgccaacacttgctcttggtatttagaagaccacggagtgaaccagagaacgttagccgccgccagcattgatgtgaacaaggccagaatcaaggccgattttaccaacacacctttgcccaacccacaggcatgcatgacggtaatctcactttcggtatagagtttgctgaacgtcattaataccccaagaaacagactcaggggtaaaataagctgcgccatttccggcacacctaaacctaacaaggatagaaccaaatttgcgggaacacttccttcaaccgccgcacccaatacttcaactaatttttggctgaagaagatcagcaataagatgaaaagtattgcgatttggcttttcagagtttcccgtactagatatctaatgatgatcacgcttattacgcctgtgaaaacttgtctttttgcaggaaagtcgctaacttcgtcgtatatctaccatttatatgcatcagtttggcttccccattgctaaaatgataccaaagcatcccatatattggtccccaattagaacacacttatcgttagctaagtaccaaaaaataatgcggtgagcttaacataacagtgaattttctttgggatgaattaatgcgcaacgtgatattttagcgattgtatccgtctttgtctttaagattcaggagaacgcatggagtttagtgtaaaaagcggtagtccggagaaacagcgcagtgcgtgtattattgtcggcgtgtttgaacctcgtcgtctttcccctatcgcagagcaacttgacaaaataagtaacggttatatcagtgccttactacgccgtggtgaacttgaaggcaaagtgggtcaatccctgttgcttcatcatgttcctaatgtgctgtctgagcgcattttgctggttggttgcggaaaagagcgtgagctggatgagcgccagtataagcagattatccagaaaaccatcagtaccctcaatgagaccggctctatggaagcggtctgtttcctgaccgaattacacgtcaagggacgcaataactactggaaagtgcgtcaagcggtcgaaacagcaaaagaatcactctatgttttcgatcagcttaaaagcagtaaaaacgaactgcgccgcccattgcgtaagatagtgttcaatgtgccaacccgccgtgaattaaccagcggcgaacgcgccattcagcatggccttgccattgcatcgggtatcaaagcgtcgaaagatctggcaaacatgccgccgaatatctgtaatgccgcatatctggcatcacaggcgcgccagcttgctgacactgccgacaacctgaataccaaggtgattggcgaagagcagatgaaagagctgggtatgaattcttatctggcggtcggtcaaggttcccagaatgaatccctgatgtccgtgatcgagtataaaggcagcaaagacgccaatgcgaaacccatcgtactggtgggcaaagggctgactttcgatgccggtggtatttctctcaaaccaggcgaaggcatggatgagatgaagtatgacatgtgtggcgcagcttctgtttatggtgtcatgcgggttattgcagaactgcaactgccgctcaatgttattggtgtattggcgggatgtgaaaatatgccgggtggacgtgccttccgtccgggagacattttgaccaccatgtccggccagacagttgaagtcctgaacaccgatgcagaaggccgcctggtgctgtgtgacgtgttgacctacgttgagcgtttcgatccagaactggttattgatgtggctaccttgactggcgcttgtgttattgcgctgggcagtcactataccgggctgatgtccaaccataacccgctggcacatgaactgctgaatgcctcagaacaggctggagatcgtgcatggcgcctgccaatggctgacgaatatttcgagcagctcgattccaattttgcagatatggcaaacattggtggacgcgctggcgggacgattaccgcaggctgtttcctgtcccgctttacgaccaaatacaattgggcgcatctggatattgcaggcacagcatggcgttcaggtaaagccaaaggagcaacaggtcgtccggttgcgctcttagcacaattcctgttaaatcgtgcaggtctgaatgcggatgattaatacccctgccccctttttgtcgcctaatagttcgacataaaaggtgtagtctagaggtatcaagggaatcaacggaattaagggtattgcggctgcaatacccttttgtatcgcttttcccatcatttttctgtaacccattctctgtaatcatgagactatgaaaaacgccaccttctatttattggaaaagctctcacaggaacaattatcgtcttctgatgaattacagccacatgaatggctggcatgccagcttgccgctgatcagtggcgggcagggaagcgggttctgattgcttgcgaaagccagcagcaggccgaaaaactggacgaagcactatggcagcgggagccaagtcaatttgtaccacacaaccttgccggagaaggccctcgttatggggctcctgtggagttgtgctggccgcagaaaagaagcaatgctccccgcgatattctggtaacactgcttcctcactttgcagactttgccacagctttccatgaagtgatagacttcgtccctattgatgaaaatctgaaacagttagcgcgcgaacgatataaagtttatcgtagcgtcagctttaatttgaccatggcaacaccgccaacctattaaatatcaagacaaaatggaaaagacacccgctaatcaaacgcaatctgagccatctctcgataaaacctataatccgacagagatagagcaacctctttataaccactgggaaaagaacggttatttcaaaccgaatggcgataccagccgtgaaagtttctgcatcgtcattcctccgccaaacgtcactggcagcctgcatatggggcatgctttccagcagaccatcatggataccatggtgcgttatcagcgcatgcagggcaaaaacaccttgtggcaggcgggtactgaccacgcaggtatcgcaacgcagatggtcgttgagcgtaaaatcgcagccgaagaaggcaaaacccgccacgattatggccgtgacgcctttatcgacaaaatttggcaatggaaagcggaatcggggggtaatattaccaaccagatgcgccgtctgggcaactccgtggattgggagcgtgagcgcttcaccatggatgaaggcctgtcaaaagcggttaaagaagcctttgtccgcctgtatcaggaagacctgatttaccgtggcaaacgtctggtcaactgggatccgaaactgcgtaccgcgatttctgacttggaagtcgaaaaccgcgaagtgaagggttccatgtggcacctgcgctacccgctggctgacggcgccaaaactgccgaaggtaaagattatctgattgtcgccacaactcgcccggaaaccctgctgggggataccggcgttgccgttaacccagaagatccacgttataaggatctgattggtaaagagatcatcctgcctctgatgaaccgtcgcattcctatcttaggcgatgaacatgcggatatggagaaaggcaccggctgcgtgaaaatcacaccagcgcacgatttcaatgactatgaagtcggtaagcgtcacagcctgccaatgatcaatattctgacatttgacggcgatatccgtgacgaagcggaaattttcgataccaatggtgaatcttctgacgtttattcggctgatattcctgccgaataccgtggcatggagcgtttcgctgcccgtaaagcgattgtggccgaatttgaaaaacagggtctgctggtagaaaccaagcctcatgatctgaccgtaccttacggcgaccgtggcggcgtggtaattgagccaatgctgactgaccaatggtatgtccgcactgctccgctggcaaaagtggcgcttgaagccgttgaaaatggtgatatccagttcgtgccaaaacagtacgagaacatgtactactcctggatgcgcgatattcaggattggtgtatctctcgtcaattatggtggggtcatcgcatccctgcatggtacgacgctcaaggcaacgtctatgttggccgcgatgaagaagaagtccgccgtgaaaacaatctgagtgcggatattaccctgactcaggacgaagacgtgctggatacctggttctcctctggcctgtggacattctccactctcggttggcctgagcagaccgaagccctgaaaaccttccatccgaccaatgtgctggtcagtggcttcgacattatcttcttctggattgcccgcatgatcatgatgaccatgcatttcatcaaagatgaaaacggcaaaccgcaggttccattcaaaaccgtgtacatgaccggcctgatccgtgatgacgaaggccagaaaatgtcaaaatccaaagggaacgttatcgatccgctggatatgatcgacggtatttcgctggaaaatctgctggaaaaacgtaccggcaacatgatgcagccacaactggccgagaaaatcggcaaacgtacggaaaaacagttccccgaaggcatcgaagcccacggtactgacgccctgcgtttcacactggcggcactggcttctaccggacgtgatatcaactgggacatgaagcgcctgcaaggttatcgcaacttctgtaacaagttatggaacgccagccgtttcgtgctgatgaataccgaagggcaggattgcggtcaaaatggcggagaaatgtccctgtcactggccgaccgctggattctggctgaatttaaccagaccgtgaaaacctaccgtgaagcgttggatacctaccgttttgatattgccgccaacattctttacgaattcacatggaaccaattctgtgactggtatctggaactgtcaaaaccggctatcaacaaaggttcagaggccgaagttcgtgcggctcgccatacactgattgaagtactggaaggcctgttacgtctggcacatcccatcattccatttatcaccgaaatcatctggcaacgtgtgaaagtggtgaaaggcatcaatgcagataccatcatgctacaacccttccctgaatttgatcagacgaaagtggacgagctggcgctgaacgatctggaatggatcaaagaagccattattgcggtacgtaacattcgtgcagaaatgaacatcgcacccagcaaaccgctggaagttctgttgcgtgatgccaatgcggatgcacaacgccgtgtagctgaaaacctcaacttcattcagtcgatgggtcgtcttacttccgtcaccgttctggcggcgggcgaagaagcccctgtttctgtcaccaagctgatcaacggtacagaaatactgatcccaatggccggtctgatcgataaagacgtcgagctggcacgtttggataaagaaatcgagaagctggataaagaaatcaacgctattgaagccaaactggctaacgacggttttgtcagccgtgcgccggaggccgttgtcgccaaagagcgtgaacgtctggcaatcaaccatgcggcaaaagagaaattactggcacagaaagagacgattgctgcgctgtaatctttcttgattgaacttcattcaagtataagccactgcatttagttgcagtggcttttttcatagtccactttaacgaccgtttatatgaacttaattttatgttttttgactgtttcccgtcctgcgcggatagattcaactgtaagttctcgctccatttccgccagacccgccatcacatgaaagaaagaacggtctgaagacataccagtatctatagcatcagtcagactcttaaatcgaacaccggataacaaactataatgtatcgacaatgttgacacgttcggtttattgtttaatatataaaaactacataaacgttgtgagggcataacaatgtcacaagttatcgttaaaaaatggggtaatagcccgtcagtaaggcttccggtttcaattatgaaagcagcgtctctgaacgtcgatgatactgttgaaattactgtagaagatgggcgtatcgtgattgtacctgtgcgcgctaaagaatatacgcttgatgcgttactttccggtgttacaaacgaaaatattcatgaagaaatttccttcggaaaaccaactggcaaggagctactgtaattaggataagtcactgttttaatcctttggatgtaatcagaacctcagaaggaataagttttgtaatcaaattgttggaaaggcaaagaggatgagtttcaatgaaatcaaaatatgtaccagaagctggcgatattgtatggcttgattttgatccgcaagcagggcacgagcaagcaggacaccgccctgcattggttcttagccctgctatttataatggtcggatagggctgatgttatgttgccccatgaccactaagatcaaaggctatccttttgaagtaaaagtagaaggtgaaggtgaaggggatagtgcagtactggctgatcaggtaaaaagtttagactggcgcgaacgcaatgctaaaataaaaggaaaagtatcggcttccgtactttcagaggttaaagcaaaagctaaagcgttaataggctgataagtttcagagcgttatgacccatgctacccgcttagagtgctttaaactccattccctgaggtaaccccttatccgggaatatcctattttcacaatgataatcaacataacgtataggccattttacatacaaaagccatgtggagttgtactctgaataagccaaccagtttaatgaacttcattcaagttaagccactgcatttaatattgcagtggctaggctgtattaacgcaacagccaatgaataacgataaaaaataccagcgaaaaaaacaggatttttaatattgaacacatatatttgctgatgaaatatgccaaaacaatcgtgactaaagaaataaaataattaatattaaactgattaattaattcacttagtgataaattattcaaggaaatattgacgataatagttccaataataaaacaaatagcataatccaacgatgtaataaacaaactatcggctttgaatgatttattgttattcatcaaaaatggagtcactctcaataagaaactaattaatcccattactattattaatagcatcacgatgatctatcctttctggttttccgttcaaatagtgcgatgaatactccacacaaaatcggtatcaccagatccactaatttcatgttcacttcattcaacaatggcgcacacaacccccccataaccgtcgccatgactgacatatccttgcctgcacgtttggcggttaaagaagcaaaatgaatgggaaccagcatcatcagaaataacgagagggattcataattaaggtattccgcagaaacatatcccagtaaggtggcacaaaatgtaatgacaaaacagggtatagcaattcccaaatagaaagtaaactgggattttccacccttgatattctctgcggaaatatgtgaatgcgccacggtataagtactggcactgaatcctaacatcgccagtaaaatattccgcttcggaataccctgaaaatattgtgacatcaccattgccatcaagaaaaagcgaaaattgatcagcaatgccaaaataataacagaaagcactgccccatcggcaagataccctaccgcagccacctgcaatggtgccgcatagatcagcaacgaaccgaccaacgtttccattaatggaatgccgtgacgttgatacaacgctccaatcgaagcaaagataagaaaaaaggagatacagacaggtaaagaatcaaccatgcctttcctaaataatggattcagcacttggcacctatatttaaatttgtagaataatcgacgaattttatatcagcaatatatacccgatagatttcgggttgcatcgcggcagcaacctgaaagatgaaggatatggccataaaggttttactataaaatgacataatactcaataagttattcatttacaggccaagatatagcaggtcgaatatcatagcaactggtttagtgatatttgtgacatacttcaatatgagaataatcaatcaatatataatgaacaaaactcattctaataatggtgaatattttagttacagaaatagtttaataatctgaataacacgctaataagaatgtatttctactgttattttcagcataaacagatgaaatcatgagaaaaatatcccaaataagatataacattattttatatacgaaaattctatcattcccattatcatagtaagtgtgattttttaattataactcttggagaaataatgaatataattctgaatatactactggcaactatcatccaattaggcatcacccaactggcttatgcaaagtccactcttgataatatccaatccacaggtgtattcagaatcgggacagaaggagcctatgcgcccttcagttatcatgatgcttccggcaagttaaccggttttgatgtggaaattggtcgcgaaattgctctgcgtatgaaagtaaaacccgaatttattgaaggcaagtgggatggtttgattggtggccttgatgccggacgttccgatgccgtcatgaatcaaattgctattacaccagaacgcgagaaaaaatatagcttttccctgccctatgtcatttctgaggctgtgctgattacccgaaaagataataacgacattaaaactttcagggatttaaaaggcagaacctcctcccataccctgactaataactttgcccagattgcccgccattatggtgcagaaattatcggaaccaatggctttagtcaggaagtggaattggtcagcacaggtcgggcagatgccactatcaatgataaactttcttatctcgactataaaaaacatcgcccggatgcaccggtaaaaattgtagcggccgataccaacgcagcacaaaccgccgtgctgctgcgtaaaagtgatcctgaattaaaagccgctgttgataaagccattactgaaattaaaaacgatggcacttatcagcagatttgggataattattttggcggagaggtggctgaataatcagaataaaattatgggtgttttttaattattcataaaccatttaaattaaaaaacttggattcgcataataagtgcaatttctaagaaaggcggtcagttgctatagtaggcatctttctcgccaaaggaaaatgcgctatggcctataaacaactgaccgaaacagaaagatatcagattttcagcctgaaagaagccggtttttcacaacgggagatttcaaagtcactcaatcgaaacccatcaacgattagccgggaattgagacgaaatcgggaggcaaagaaatatacgcctgaacaagctcagcttaaggccgtagcgcgccgacagtgtgctacaaaagcagtaaaaatgaaaccagagatagaaatgtggatcaaacagttaatttggcaagatttaagtcctgaacaaacagtcggttatctcaaaagggaaaatataatatctttgcatcatgaaacagtttatcgattgatttataaggataaaattaatggtggtaatttatggcaacatcttagaattgcgaaaaaaccgtatcgtaaacgctatggaagttatgagcgcagaggaaaaattaaaaacagagtcagtattgataagcgtcccaaacttgttgataaaaagcagcgtattggtgattgggaaggagatactatcgtgggtaaaaatcataaaagtgcattattgacattagttgaacgaaaatcgttatttactatcataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtatcagagcgggagattaaccttgtggcaaaccgattaaataatcgtcctcgtaaaacacgagattacaaaacaccgaatgagttatttaaaggaatatcctctcatttacttcgtccattacggtgttgcgcttaatatgtgaatccaagaaacacttttaatctcggttttcttacaggatctatcatttaatcaagttacatataataaaaacaccaaataaaatcatcacctttatattatgttaaccccaccctcaataaaacatattatcataataggcattattaacttagctgtatctcaaactgcaacaaccagctctataaaaaacgtctgccataatcgatgaatttatcatttttatcaagatcactgacttactcttggttctaagctataactttattttatataaagatggcattgtattgcaatatcatcattaaaagaactatgcaaaaaataaagactttttgaacaacaacctatctctgtagctaaacccgctattctgatcagataggctctgatatgttgtataaatatgtctatccaccctataaacaggaagaatatatgaccccatcatggctcagtttagcgctggattccctttggccgatgctttacgctggcctgacatttaccattcccctcacgctgattacattcgcattggggatttctttggggtttatcgtcgccttaatccgcctgtatgggtcaaagccactggttgcagtcgttcggttttatgtctggctgatccgtggtacacctttgctggttcaattgtttctgatcttttatgccctgcccagtgtgggcattacgctggaagctttcacctctgccgtcatcggctttactcttaatgtcggtgcttatacttctgaagtgatccgagcagcactgatttcggtgcctaaagggcagtgggaagcgtctcactccatcggcatgagttggtggcagtcactgcgccggatcgtactgccacaggcggcacgggtttctattccaccactgtcaaatacctttatttcattggtaaaagatacctcactggcttccgtcatcactgttccagagatgtttctggctgcacagcgcattgcagccgtcacataccaaccgctgatcctgtataccgaagccgctatcctctatttgctgttaagttcagtactgtcagcactacaagttcgtctggaaaagaaattctcccaacaattttcccaacaccgcagcagtaaggaagcgaaaaatgattcagctctctaacattgaaaaaagtttcgacggacaaaaggtgctgaaaaacattagcctgaccattaaagaaggcagcctgacagcattgatcgggccttctggcagtggaaaaagtaccctgctacgctgcatcaatctgttggagatcccacaggcgggtacattggaaattggcaaagaacagataaccttcaccggcaaagaacgcctgccgcacagggaaatccaacggttcagcctgcaaacgggcatggtattccagaattttcagcttttccctcaccttacagtgattgaaaacatcatagaagggctgatttatgtacaaaaatggccactcgaacgcgccagagagcgggcgcaggaattactgaaaaaagtgggtatgtcccataaggcagatgtctggccgaacacattatccggtggtcaacaacaacgtgtggctattgccagagcaatggctccctctcccaaagtgctgctctgtgatgaaccgacctcagcccttgaccctgaattatcgaaagaagtcgtttctgttctgaaacacttggcagaagaaggcacgaccatggtaatggcgacacacgatctgcgtctggccgccaatcttgcccacaatgttatctttctggaatcaggcgaaattgtcgaatcgggaacagcacaaaccatgtttacccgcccgaataagcaacgcactggcgagtttatctcaaccctgacggaaactttacctgattgggaaatataacgggctgtgacgtttagactcagcgtaaacccgttaagctcaaataagcatagtgacacattattgatttggagaaatacaatgaaagcattcctgagtttgttactggcgggtgccacagcccttacaatttccgcccccagttatgccggaaaggatctggacgcgataaaagcctctggtgtctttaaagttggaacagaagggacataccctccttttacctatcacgatcaggccaataaattaactggttttgatgtagatatcgcccgtgaagttgcacgccgcctgaatgtcaaaccagaattcatggaagtcaaatgggatggtttgattgcggggctggatgctaaacgttttgatgctgtgatcaaccaagtgggtgtcacacctgaacgagaagcgaagtacagtttctccattccttataccgcttcccaagtcgtattgattactcgcgataataacagtgatattaaaactttcgctgatatcaaaggaaaacgttcagcccagtccctgaccagtaactatgggcaactagcaacctctaatggggctcatttagtcagtaccgacggctttaaccaagccattgatttggtcgctacgggtcgtgcagatgcgacattgaatgatcgcctttcgtttctggatttcaaaaaacagcgtcctgatgcaccagtgaaaatcgtcgcccagcaagctgatgcaagcaaatcggccgttctgctccgtaaaggagatccagaactgatcgccgtcatcaataaggcactacaagacatgaaagatgacgggacttatgcccgtatttccgaaaaatacttcggcactgatatttccaaataacctgcctctcaattcctcaatcagcggcgttttcatcacgccgctcatcaataaattcagcgaatttatcctgtttacttatttgttttttcaattaatatcaagctgatagtgacttataaagttaacggtatcctcaagtgtggctccaatccccttatcctccttgagtcatatctccccccaacaagctgcctgtttcgggagaattttaagtcaaaataaaaaatataaagaggaaataatgactgcaacaacaacacaaaactacgtcattcgccccattactccacaagataataccggcattgctgccgttatccgtcaagtatccgccgaacatggcctgaccgcagaccgaggttttgccgtcgcagatccgattctggatacattgtacgaagtatacaaccagccacgcagcgcttactgggtcatcgaaatggatggggaagtcgttggcggcggaggcgttgctccactggctggcggtgatgatgatacctgtgagttacagaagatgtatctctcatcagtactgcggggaaaaggtattgccagacaaatcgtgaaacagtcgctggaattcggtatagaacagggttttaaacgttgttatttggaaacgactgagatcctgcaaacggccattaaactgtatgaaaaactgggattcagccatcttggtgagccactcggcaataccggccactgtgactgtgagatcaggatgatcaaagtgctataacgcttacaaaggtggtcactaatcagtcagccccacagaccaagtggggcatttatttcgacaatctcgtcagaaaaacttagtgaagtttgcgttcgtcttgctcagggaaatcttcagcttcgtcttcgtcttcgtcttcatcatcgggcgcattgggatcttcaaaatacgtcccccaaccatcgtaattcacaccgagcttttcaaccagattcatgagctgctcaacctgagtattaatcagttcagcatccagacggctttcactgatgatgtcacagcacatcagcacaacacgatcttcagtttccagctcttccgcatccgtcacttcataaccgagtttgaatgcttcaacggcggctttttccaaaagatcgaagttttccgccgaaaaatggtgctcaataatataaagcgcatcaggatcgctgccatcttccaataattcttcaatgatcaagcgagtttcttcgcgctgttcttctaaagcatgtgggtctgccatgccaatcccctccgtcatttggctgtcctgttgcgcattctcccatctttttcctgcgaaggatatagctatccaatttcgtcaaaaaggaaatacagaccgtgaactatggcatgacaaattgttttaatttcattgaaatgacaaatacacatcacaggggttgtaattgaattttttatcgatatatattgaatataaattcaatatcactctaatggagaaaatacagcatgaatccattttatcgacgcaatttactaagattacatgactatactccttcagaaattaatgtatttctgacactatcgagtgaattaaaatcgaataaaaaatcaggtaaagagtcgcctttactgtcaggtaaaaatatcgcgctgatttttgagaaagactccacccgtacacgctgtgcctttgaagtcgctgctcatgatcaaggtgccagcgtcacctatttaagctcaaatggcagccagattggacataaagaatccatcaaggacaccgcacgggtacttgggcgtctgtatgacggcattcagtaccgtggatatggtcaggaagttgtcgaaacgctggcgaaatacgccggcgttccggtctggaatggtttaacgaatgaattccacccgactcaactgttagccgatttactgacgatgcaagaacatagccagaagccactgactgaaatcaaacttgcctatttgggcgatgcccgcaataacatgggcaatacaatgctggaagccgctgcattaaccggtatggagctgcgtctggtcgctcccaaaacgtgctggccggatgcagcattgattgccgaatgccaaactctggcagaaaaaaccggcggcaggatcgccctgacagaagacattgcgaccggcgttaaagatgccgattttctttacactgatgtttgggtttcgatgggagaacccaaaacagtctggcaagagcgcattgcgctgctaaagccctatcaagtgaatatggatgtcattcaactgacggagaacccggaggtgaagttcctccactgccttcctgcgttccacgatgaagaaacaacgcttggcaagcaactggctgaggagttcaatctgtatggtgggctggaagtcactagtgaagtctttgaatcaaaacacagtattgtgtttgatcaggcagaaaaccgtatgcacacgattaaggcagtgatggtagcaacgctagcgaaagaacttagtttttgatgggtgttaatgcggtgcgaataagcaccgctttttgtttttcaaggtatagacgacttattgggtagtatccaagtatcctctgaagacagcgtgagtgcagaacatcgttgtgcgtaacgaatgctgtcttccagagacatactctgtaaccaacagtgggcaagacctgccatcatcgcatcaccagctccactggcattgagcacactggtggtaatcgcacgtgaatagcctgatttattatctagttcactgtagtacacaccttccgcacccatacttaaaattaaacgttgaacaccttgttgatggaaccaggatgcggcgatagcggcatctttttgggtctcaatttctattccactgagaatttcagcttcagatcgattgggtttcagggtgtggatataagatagccaatggcggatcttagtcgccttaaatgtggaaacggtatcaataaaaatcggcacatttccagcatgattaaatagccattccaatgctccttctgtcagattacagtcaatgactaatacactagcacgtcggattaactcttcggactgagataataatgtgggcgtgagcttttccataatgtccatgtcattaacagagactatgcatttgccattttcatcaatgatggaattacagatcgatgttttttcttcatctaatttatggaaatatctaatattaacaccagctagtttcgtttgttcgaataataccttgccattataatcattaccaacaacagaaatgaaatggctttcacttttcagtgcagcaatattttgtgcaatgtttcttccgacacctcccggcgtcgatattattttccctgggttggaatcttcatacactaacttttcagaggcataactggtgaaatccatattggctgcgccaattgtgacagcataagcattattagggctaggaaaaatatatcctttgccttttatatgaccttttttgttcatattcataatgtgtcctgctacacatgaacgactaaccccaagaatatcagcaatttcttgttgctgaataaaaggatcttgcttgataagtcgtaatatctggttttccctgcttggcatatcatgcccctgattatttttttagtgttaatgtttttatttcatttctgacgaacagtaaagattatttttatatttcgttcttattatgcggaagtgatcgtaatttttataagatgtattttgtggtataaatcgtgattttcatcacaagtattattctgtaaaattaacaaaaatcagcatgataaaaaaatccatctaggttattagattttattctaaaattattacattaataacaatatgttatggtagctaaatgtattaccaaacaaatgtttatttttcattggaattaattttttatcgaataaatgagtgttttttacaccagaaatgaggtatttttttgaattgcggcaaaagtccgtcttcgtgacatttattggaaaagcaagaaaaactgttctgttcagcaaaaactgtacacattttactgccacaggatgcgtacgtactacagggtgaaataatggtggattttttacgtgttgcttgtaaccagcgctgatgttctccctctgtattgcgataatgatgctttggtaaaggcttctagccctaccagcaacgcttttaaaggttcagaaaatgaattagactcaataaacaacccttattgaaaaagacaaaaaattattatagagaagtttcaacacatccttttgacatggaaaaaattagtttgactaaatttctcaataaacatattgaggatgatagtttttatctatttaaattttgtttaaaaataatctttaacaaaatgttaaattacatttttaaatagatctggtcactgcgctacattctttttagaacattattttttaaataactattttctataaaataaaattatcaatctttaaattataaaaaataaaatgcccaacgttttatgctctccattatagatggttatgtggatcttgcgtctgatgcaacaccgccaacacttcaataccagtcgaaacttcccggtagtaaataatgtggttctctacggggaaactcaaccgtgaacggggcaaatacatcatcaatactatgcaattcgccacgatcagcttgtgcaatagattcagccagaacggcttttaaattctgtaacttgagctgtgtgaactgatcatactcttcaggagagataaccacggccacacgctgaactttcataagcagatcaccaaactggttcttagccagttgtgcgggaataatttccatacatcacctaccgtctaaaatggctcaaatagctattatagctaaaagtgtatagagcaaccagtacgcaaaatagccaactaactggtcgagtagcccgagaggatctcacccacaggctactcgaccagatattgagtgtcattttcagaacacgattgcacgaaatgtcaggagtcggcttgcactcgattgctggagttgtggaacaaatatctgacccgattttgggaggtgggagtttcaggagcaacggagcagtaaaggcgctcatcgaacttgatgtgatattgcaaggacccaaaatcgggcgtaatcacagttaccgtttaaaccctcagttcggctggaaaggtatggtaaataatcataaagaaactcttaccaatggcctgagtgtaattcagggcggccgtgcttaaaaaagttaaagccgcctgagtaggcggctttaacttagagttttagacatattaaacccagtgatatgaaaaccacttttttcgtatagtgctttagcaactggattattgggagcgactctcaaccctacctctgtgatacccatagatatgagattacttttcattttatccagagttgccttacctaatcccttatgacgccactcgggtaataagctaaaatcacaaacccacgcagctttctctttaagttctatccatagataaccaatcactggcagctcatgatctgatttcacaatacaccagaatttgtttatcactttctctgttgcttgggattgggttacatcaatcaactgagaggcttttttaagtgatacgtctgccggataacctcgtgttgaagctaagtctaatgcatactcatttataaaaagtaagcggaataattcaaactcagcagttgtcatttctcttaattcaatcattttaactccctagataaaaaataatttttctgaaatatcattaaaaaaagcgtttacaagacgttaatttatggggtgtttcatccttgaaaacccaaagtctattacctgacattactgaataagttaggttaaaccctacatacttgacccatagtcagggtctgatctcttccgtatttatacaggctccggtcgggctaatgcctctgcctgtaattggagtttcagcacctgttctgcctgtagagattcccgaactgctggagcggcaacgatgaatgccacccatagaaacaaaaaatatacgtcaattgagatttcagatgttatctccggctcaacaccaacttaaacgcaaaaaacagaaataatccccctgtcgcacggttcatccatttaataacattttcacgacgtaatagatgggaaagcgggcgggtggcatatatcagcaataatgaccatatcgtgccgagtaatatgtgaatgctcactaagccaaatatccataatacgggtgaatgtccttgaggaataaactggggcaggaaggagacgtaaaatacgcctattttggggttgagcacattgcccagcatacctctgataaaccagttctgcgttttaacaggggaggaagcggtttctcctgcaaggctctggctgggacgcacaatcatctgaatacccagccaacataagtaaagcgcaccacaccatttcagaatattaaatgcctgttcggagacggcaattaatgtgccaaggccaaatgccaccatcgcgccccaaataaaacatcctgcattaatacctaaagcagcgtgcagggcttttttgccgccctcaacggccgctgtccttaaaaccagagccgtgtccaaacccggagttgatgtgagtaatgtagcggcaacgatgaatgccagcagagcatcagtaaccaacatggtaatctccgaaaataagaatttaattgaagcttatatatttgaccggcaccgattttgtcaaccaaacgccattatctgcctgatggaatttaaagccctgttcatgcattaactgggcgttaatttttaggatatccggcttgccatgacgctgcccgactttaatggctgtggcttcatctgccgataaatgcacgtaatggcgcgagcctgccaccaatccctgctggaaaatcgaatccagaaaacggatggctgtaccgtgatacaaaaccgtcggcgggacttgcgcttggtaactaatattgaccttttggtttgaatgcccctgtaccgctctgattcgtttttgatcgtcagaaatggcaaatcgctttttatcattggtttcgacgatcgttgcgatcagcgcataattcaagtgcttaccatgtttctccgcacatttaatcagctcaccgatatctgcccacccttcattatccagcgttaggccaatagattcaggttgatggcgtaacacatagcttaaaaatttgcttattttggtatcgacttgagccattttttacctattaatatgaattctcttgtttgaaggtgtctctttatactcgcttcatcacccaacgccttaaataatcatccagtagtgcatagctgcgttcacgcttatccttgagttcgcaacgagacaatgtttcatcaagttctgattcaataaaggcgtgaaccctcagcttacgcaggccatattctgactcattcgctaatcttttactccgcaatagatcactaatttccgctttcaattgaggatcatcgactgtacctgccaccagcgtttcaaaatcaatcggcggtacgcccttccccatctcaatccagcgaacagcaagtaatgggcgcaatacgtaaaagtatttttttagccgaacttcttcaccttgcagataacctcgaaagtttttctttgccatcgaaagatagtggtagcgcgctttgatacccgaaaagaaatgcggcaccatcgtttttaatccattggtagcggccggatctgcctgataaataattggcgaatctaaccattccattaaagttggattcgcctgtttcagtaactttagtgtcttacgcagttcccacccgcagatatccagctcatcgctgatcggcagttcgatcacatcccgccctgcttctacaatgagataccaatccacgggatggacataaataaaccgcacatcgtaatcactgtcgggtgaggcaaagccccacccacgactgccggattcacaggcgtacagtatctgcacgccataccttttctctatgccagccaattcctgtttgatacgggtacgcatgacagagctaactgctgttgttttcttttccattacttccatttttcctatgactatttttatccttttacgcaaactacctgacgcagggtatgcacaatttccaccagcgatgactgagcttccatcacagcatcaatatctttgtacgccattgggatctcatcaatcacatcgctgtctttacggcattctacatgcgcagttgcgcgcttttgatcgcttacggtgaaacgttttttcgcctcagtacggctcattacacgccccgctccgtggctgcatgaacagaaactttcttcgtttccaaggccacggacgatatagcttttcgcgcccattgaacccggaatgatccccatctggcctttacgggcagataccgcacctttacgtgttaccaaaacctcctcaccgtaatgctgttcacgctgaacgtagttatgatggcagttcacggcttcctcctgtgtcgtaaacggttttgggatctcgcgtgacaaagcttcaagcacgtggtgcatcatcacttccctgttctggcgagcgtaatcctgtgcccaaccaaccgcttccatgtaatcatcaaaataacgactaccttcttcgaaataagccaaatcacggtctggcaggttcgcaatatgctgctgcatatctttctgcgccaatgagataaacaagttaccgatggcgttacccaccccacgggaaccgctatgcagcatcacccagacacgatctgcttcatcaaggcacaattcgatgaaatggttaccggttcccagtgttcccaaatgctgatggttattggtgttcagtaattttgggtatttatcggtaatacatttgaaaccatccgccaacgtcgcccaatgctgatccacaagttccggcgcgcgatgccaagaacccttatcacgaccaccacgattcacagtacgtccatgtggtacagccgcttcgatggcatggcggatattcagcaaactatccggcaaatctgatgccaccagggaagtacgcactgcaatcattccacaaccgatatccacaccaaccgctgcgggtatgatggctccacgtgttgggatcacgctaccaatggtcgatcctttaccgacatgaacatccggcattaccgccagatgtttgaatacaaaaggcatcttggccgtgttctgtaattgggtaatggctttcggatcaacagggactccgttagtccacatttttatttgagcaccattttcttgcgtcaataaattgtaagcgttggttttcatttcaatcgttgtcatttttgttctcctttaatttgtaccagtccattcagaacttgatctaaaccgccatataccgaaatttgattgattcgttcagcgatgctttccagtgtttccagctctttcaaacgcagagcaatcgggttgttttccatcactttcgcggtattcaacagtgaacgggtcgccgcagtttcttcacgacggcggatcacattggcctgtgctgctttctctgcttctactacccgcgacagaatagtcttcatctcgccgggtaaaataatgtcttttacaccgagagagaccacttctaaaccaaaacccgctgttatccgctggactttttcatttatcagttcatcaatcgcctgtttatcttccagcaattcatccaatgaacgggttcccaccatttcacgcaaagcaaattgcagttcgcggtacagatatgccactggctcgctcaattgctcgtaagccatcagcacgtcgtgataacgccagttagcagataaattaatgcgcaagttcactttgtcccgggtcaaaatttcctgcccacccacctccaatgcctgtaatcgggtatcgacaatttcaaccgtcacatcatgaccaacttgccaataacccgcctggccgggctgcaataacttctgcgccacgccatcaactttcaaaatgccgacatgccacgctggaacttgagcaatcaatacgctatctatgcctttcacgctatgtttacgcaccatagaagacaccagcacagaagctagctcggaggaaacctccagttccgaggccttaagtacctcaacgcaacgtggattaccgttcttccaatataagtagcgggtcgcgggggatagaatttccaccaatacgtcgtgttcatacagcagccccatctcatcatcagcaatctggatttcatcacaatactgttctacccaatcaatatgctgatggcgaaaatactccgccaaactttcttcaacttgtggccatgaacgagtatcgacaagctctacagaaatatcgtgaccaaagcgccaataaccttttaggcctggctgcaacaactgctgcacgatgccatcgcttttcaaaactccgatatgccatgccggaatttgagtaatcagcacactttccaatcccttcacattgcgtttacgtatctttgaaggctgtaatagagaaaccaactgtgaggaaacctcttgttccgtggttgggcatacttcaatccggcgctgatcaccgtttttccaatataaacgacgcgtcgctggtggcaggatttcggtcagtaaatcatgttcatacagcagcccgatctcatcttcagtaagctgaatatcatcacaatgctgagcaacccaatccgtatggtactggcgcaagtgttctgccagttttgcttcaatttcgttgctattaagttcaaataccgtcagtctcagcttgttaaaccaatcgatgaaacgatatttacccgccgttaaaatctgttggtattcaccctcttttgccagtaagccaatttgtccctgcaataatttgatttttttcatcattgttattttccttttttatattcccttcactcggaaaaccgaacatcagggcgaaaccaaggggggaacacatcggtactcaaacagcggtagctcagtatcctgcccttggctcagcgacatcagccgggtcttcagaatggtggctctcgacgggcagccacagggttttacttctacgttttattttgtgttttaccgggaaagtaaaagaccatatcccttatatggagtgaacctgggactcgaacccaacgtaaccctatgttgttcacgaaatgtctttctactgacggaatacatgtggcgcaatgacctcatgccatcacccatgtaccggctgggtttaaccccatgctatttcagtgtgcggacatacgagttattgccaattgcatgccaactttgaaaaaaaacagaaatatttatatctatttgaaaattaattatttttatttgaatctgttttagtgattgtttttacagtcgattttttttatcttttcatatcgttgtttataaaattagataattgcatcacaggggagagcatgaaacgcagagttgtcattgggattttgggtacgaagttggatagacggggcaaaaaggccaatcgctggacaaaatggcgccctacgattggtatgtgccagcaagcggagttgccgattgacaggctggaactactctaccaaaccaatgattatggtttagcacaaagagtgaaggaggatatcgcagagacttcgccaaaaacgaaagtggttttgcaagagctcaaaattgaagacgcgtgggattttgaagaagtctataccgctcagcttgattttgccgtgcgttatccttttgatactgaaaatgaagaatatctggtacatatcacaacaggcacacacgtcgcccaaatttgctggtttttgctgaccgaagcccgttacctgcccgcccagttgctccagacttcccctagaaatggcgatcgtgagagccatcctgaaggcaactacaccattatcgatttgaatctcagccgctataccaccctgaccagccgttttttgcatgaacagcaggaacaggtcgcatttctgaaatcgggtatcgccacgcgcaatgctaattttaaccgcttgatcgaccaagttgaacgtgtcgccttgcgttcttccgccccaattttgctgacggggccaacaggtgcaggtaagtcttttctggctcgccggatctatcagttgcggcaatcccgccatttgattcaaggccgttttgtggaagtaaactgcgcgaccctgcgcggtgataatgcaatgtccacactatttggtcatgttaaaggagcgtttacgggtgccattcagccgcgtacagggctactgcgtgaagccgatggcggcattttgtttcttgacgaagtggcagaactggggttggatgagcaggctatgctgctaaaggctattgaagagaaaagcttcctgccttatggttctgataaagaagttcacagtaattttcagttaattgccggtactcaccgcgatctgcacacttgggtggtacaagggaaattccgtgaagatctgtacgcccgtatcaatatgtggacttaccaactccccggtctggcgcagcgtcgtgaagatattgagccgaacattgagtatgaacttgcccgatatgcacagatgcagcagacacaggttcgcttcgataaggaagcgcgactgatttacctgcattttgcctgttcagaacaggcgcaatggcggggcaacttccgtgagttaggcgcatccgtcacacgtatggcaacattcgccgaaaacggacgcatcaatcagcatttggttgaagaggaaattacgcggctcaaacagaattggcaggataatgggctttcttccctgctgccgaatcatttgccggaagttgatctgtttgaccgccaacagttggaaacggtcattaaaatctgccgtgagtctgccagtttatccgaagcgggccgcaagctgttcgccgtttcccgccaacaaaagaagcagcccaatgatgccgataggttacgcaagtaccttgcccgattcggtctgggctgggatagcattcaaaatgattaggagataaataaaatggaactgaaatttttaggcaccagcgcgggggttcctacgaaagagcgcaatgtcaccagtctggttctggatttacggggtatccgcaatgcgctgtggatgtttgattgtggtgagggaacacagcaccagatcctcaactcctctatcaagatcccgaaactggagaagatttttatcacccatctacatggcgatcatatctttggcctaccggggttactgtgcagccgttcgatgggcggctccaccgatcccgtgacgctatacgggccaaagggaatacggcagtttgtagaaaccacattgcagttgagcggctccttcctcacttatccactggatattgtcgaagtgcaatccggactgctgtttgatgatggcgagttgaaagtcacggcttacgcccttaaccatcgcgtggaatgctatggctatcgcattgaagaacatgacaaacccgggggtctaaatacccagagacttaatcaggataatattccccgtggctcgtggatgcagaccttaaaacaaggaggtacagtgacattagaagatggccgtacggtgtgtggcaaagattatctgggtgcaccgatttccggtaagtcgctggccattttcggcgatacgacaccaacgcccgaagcactgaagctggcggccaatgttgatgtgatggtgcatgaaattacgctggaagatgcacttgccgaaaaggccaataacaatgggcattccaccacaaagcaagcagcgacactggcgcgcgatgccaaagcaaaacactttatcgcaacacatatcagcggacgttatggtatagaagattgcccgcgattattagcggaatgtcgggaaatattccccaataccgatttggcagaagactttgcgatatttatagtttaataaagcatcaatttgcacatttgatactcttatcaagatcaaatgtgtttacccgacaacgatacaaagctttccttagatccagtctacgaataatatttaaaatagtagtttcatattttaatatatttcattaacttattgttttataaacacttaattttaataaattcataatttatgaaataataaaaccattttttatcattttattttttgtcaccatttttaggtgacatattaacatttttttaaccaatataatgctcgcaatgacacctccacttaatatgcaagcatcaaagctagcatttagctagtgtcgcctattggtaggtaaataatatatatactgaaggaaattataaataaaaattaacattaaataaattaactaacaaccaaaataacgatgataaaaacttggaaaataaatccaaatttcttatttcatcgcaatttttaattaaaaaaccagagagtcaataatgaattcaatcataaaaacagatattaaagaaagtatgtataatatttttacagaaaacacagataatatctggtctgactggcttgatgaaaaagaattaaaaaagctgacagatcaccctgtactccagtcatttaatgatagtacagctagtgaagaaatgttaaaaacattcctaattcaacattgctactattctcgtcattttacacgttatttaatcgcgcttataagtaaattagacgtatttgaagatataaaagatcttcttcacaatttactggaagaaatgggattagaggatgaaaacaaaatcactcatgctgagctttttcagagaacattgaagactgtcggtgctgatatcaatagtcaaaaaccttttgaaaatacaaccgctatggttgacgctatgttttctttctgtctttcagatgatccgttagaggggctgtcagccatgtgccttggcgcagaagctatcgttcccttaatttataagcccgtattaaatcgtttaatgacattgaattacaataaggatgcaacagaattcttcacactccatattgaagaagatgaagatcatgctattaaaatgtttgagatcatagatagactcactaggcaggacgaatcattacgcctcaaagccatcaatattggcagtgaaatgataagaaaacgcgtcaaaatgctggatagtgtctgggaaagtgaaattgttcgtaagaacaatgtagaaaaggccgacttaaataatcaaaaaaatgatctttcctttaattcttctgatttttggcgtgtcaaccacaaatcaacaccttctattcctgagaaactaattcataaaaacgtcattaacagtcatagtcatggtgaaaataaattttcagaagaaagaaaacataaagtcaatatcgtcaatttgcccactaaaacaatcagtatgacattaggtcatcttgaacccggacaatcgacgaatctgcaccgacataattatgaaactgtcatctatatcattgaaggggatggcgtatcaaaaataggaaataatgatgttgcttggtcagcaggagatgccatttatatcccatcctgggtagaacataaacatagcagtgtgaatcagaatcaatgcctttatattgcttgtgaaaatgctcctttattacaaaatattggtaacatcgcacttcgtgaagaattagaataattaataaagaaggtgatttattatgtcattagccacattttctacatttgaagctattgctagcacaactaaatcaataaatttagcgcaacgatttgtcatggaaaactcgtctcttgataaagactgttttatcgggccagacggctcattgagttattcccagcttgcattttttgtccaaaaaagtgcttctgctatgtcgttaaaaaaaatagaaaaaaatacagcagtcatcctctgcctcaatgacagccgggaattagctattattttttttgccagtttagcaattggagcgttaccggtcgttattaacccgaaattaccggctaatactcttgattacatactgggggaatttgataccccttttattttcctcgatgaggataatcaaatatctattgcagctgaagcgaaagaaaatactatccgtattaaaaggagtgccgatctttcggcattctgtgattggatgcctgaaaacaccaatgataaatggcatgattttttggaaaaaacccattttgagcctgctttcattcaatatacctcaggatcgactggaaaacccaagggagtgattcacagcgttacatcaattttgtcttcctgtgaacatttttctaaacatcaattaggtttaactacaacagacattatctattcaacaccaaaaacattttttggttatggtatgggaaataccctatttttcccgctatttatcggcgccactgcaattatagatagcctttggccttcaataacaagggttacggataatattaaacaatttcaaccaactgttctgttggcggggccgatgatatttcgtttattacttgaagatgatgaatttaaacaaaattgccatcttcgtctggtcgtttcttctggctcaatgttacctgcacctctaaaagaatcctggtttcagcggctcaatatagtgatacatgatgcatttggcgcgactgaaacatgccatgcttttgcgacaacttatggtcatccatcccgatcaggaagcattggaaaatttattgccgggtgtacaggaaagattgttgataaagatggaaaaaccgttccggctggggaaactggcgtgcttatgctgagttcagaatccttagctctgggatattggaataaccatcaagatacaaagatcaagttttccaacggttggtatcgcactggagatctattttcgcaagacgacgaaggattcctttattatcacggccgtgaagatgaacagttcaaggtattaggacgctggttggtgccggtagaaatagaaaaactcgtccattccgcttttccagaaattggtgatgcatttatgatcccttggatggatagtatccaagaatgcagacctgttttatgtctgaaaacttcttccagtgaatttgaagcaatcagccaacagatagccaattttatcagccaccaagtagaaagttataaacatccctatgtttatctcaatttagaacaattcccactgaatggaaacggtaaaattgatcgtaagtcgatgatcgaaatagcacgccaaaaaattactgaccaaaatatgtcttctcatcctcggagaattaattatgctcaatcttaatgaatttcttgcttatggtgaagaaggatataatttggtgccagtatggaaaaatatcaaaaaaacacagatatctcctattagcatttacgaaaccttagctaacaaaagctatagttatctttttgagttatctgaaaaatatgaagataaatatagagcaacctattctattgttgggcttccatgtcatcaacggatcgaaattaaagattattcaatcaaagtatttgacgaaaataatgctcagactcatataacagatattcccccactggatgctctgcggcaaatactgacaagctatcgtgtaccaaaaattgatcaattacccaattatgctggtgggttgtttggttattttggctttgaaaccacacggctcatcgagcctaagctccaagccaatacacgtaaaaaaacattagttgatttaccggacatattacaaatagtcagtcaagaattgatcgttgtagatcatataaatgatctcatctatgtcattgtccatgcaaaaccaactaaatctcaaaattttactgatgcaaatctaagaataaaccagattatcagtgaactggaaaagatcccctatcaacaacaggctaacttcagtccttctactaccactgatagaacgacttggttcaaggacatggagtctcattttccacagcatgactttcaaatggccgtcaacaagatcaaggagtacatcaaggcaggtgatgccatgcaggttgttttatcccaagccatgtcccgaccattaaaagccaatgccatacagctttatcaagcactaaccagtatgacaaacacaccgtactgttatttgatgaatgtcgaagatagccatattgtcggcgcatcccctgaaatgatggtctccctgcatcaaaacaaattgatcagccatccgatggcaggaactcggcatcgtggcatgaaccagcaagaagatgatgcactgaaagccgagctacttgcagataataaagaaattgccgaacacattatgcttgttgatctggcacgcaatgacattggacgcgtagctaagacaggcagtgttacggtcaataacctgttaagtgttgagtatttctctcacgttatgcacatagtgtcggaagtatccggtgaaaaaatggatggtatcgatgaaatagacgtcatcagcagcacttttccggcgggaacactcagtggagcacccaagatccgggctctggagatcattcatgaattagaaccctatggcaggggcgtttatggtggttgcttaggttacatcacttggaacggcgatattaatctctctatcaccatccggacagggttacttcatcagggacaactgtatgtacaggccggtgctggaattatcgatgcttccagagcggaacgtgagtggcaagaaacgatcgaaaaaaatagtatgatgatgcatgcagcatatcaagcagagcaattttctttatgaaatggtataggaaataaatcatgtatttcattatagataactatgactcctttacttataatattgcccaatatttgggtatgcttggtatagaggttttagtcaaaaaaaatgatcgaattaccttagaatatatcgaacaacataacccgactggattaattatttcacccggcccttgtaccccgaatgaagcaggaatatcaacacttgccattcaacattttgctggaaaaattccaattttaggtatttgccttggtcatcaatgtatagcacaagaatttggtgggaaagttctcagagccaataaagtgtatcatggccatacttcaacaatcacccataatgataaaaacttatttgccaatttaccccaagatattaaagttggttgttatcattcattggtagtagatgacttgccggaatgtttaaccgtgacagcaaggtcatgtgatgaatacaatgacattatggcactcaaacataatgattttcctatatatggagtacaattccaccctgaatctattctctctgatttcggactggatatgcttaaaaatttcatcaagataacacaagaatggaagccgatgaatagaatacaataatccgcgctggcaatatcagtagctatatacttgccataaattatatagtcttacaaataatcataatgtaataaatcattttatacattgatcttaaaggaaatattgaccaatgattacgccagaagaaataaaaaaaattattagttcggaaaatattggtgccggtaactttattcatcacctaaataactattttagcgaacgagaaatgagtccaaaaataacatgtgatgtaccaacatatgataatccagaagaagaaaaatcacagtttgaaattaatgatcttgttaagatatcagatcagttgtcaggggcttatattgcactaggcgtccaaaaacgggaaccagtggcattatattttgatgatactattgactatttaattcattttattgcactgaacaatataggctcgtttcctatttttgtgaatggcgatctcagtagtcatattgctatgtcgtttatgcagaatagcggaacaaaatttattatttcaacggaagaaagaattcactcactgggtgataaagctgctggcatccagtttgttactcccaatgaattgaatttattaaaaaaacccatttcaagatattaccaacatcatgcaaacgatattattctgttagggcatacttccggcacaaccggtttgccaaagccagttatttttacccatgaatctatgtttcacggtattttgaaagaagtcgctaagcaacgcggaaaacaaatattatccatgttcccgcactctcacggagcctctatgacattgatcatgttgacattgacacgaggtgcggcaatacatattcaatcaaagaaaaccgcttttgacattttagattccattgaacaaattaaacctgacaccgttgctgcttttcccaaaatatttgttgatctatgcagagaagacctcgatgactgggatcttaattctatttcccactgggtttccacaggtgacgcgaatcacgaaccccatatacgaaagttgatttcttatggtcatcatttcgttgatggcaaaaaagcgcgtggatctttcttcatcgacaatcttggctcttcagaattcgcatttgccatgttcagaaatattcatcaaccaaaaacagacagatatgatcgttgtattggaatacctttttcctgggttgatgctgccatacttgatgcagacggaaatgttctccccaataaccaagtcggtatgttgggcgttatttcaaaatcagtaaccacgggttactggaataaccatctcctgaccgagaaaaaccgggttaatggttattggttaacaggtgatttggtttaccgtaccaacgacggtttcttttaccacgttgatcgtacatcagattggattaagactccccaagggccactttacagtacccaatgtgaagagtggctgttgaaaaatatcgatagtatttttgatatcagcattgtcgctacctccctgcccaatggcgatcaacagacaacggctatcgtcgagctgaaagcagggcacgaaatttcgccggccacactgttacaaaacatcaacgcctgtcatcaggaaaaacaatggccattgatcgacaatattgtttatcaatccgctgacaacgatctcggcgtcacagggaaaaaactcaaaagaaaaatcagagatcgtatgcctgaagataattcaatggtaactgaagaaggaaattaatatgaaaacttgcttaattacgggtgccaacagaggcatcggatttgaaattgcgaaaaaattgggtgaacgaggccatcgggtaatactttcaggccgtgatatacctgcgcttgaacatagtgtttcacaattgacccaaatgggaataaccgccgatttgcttcatttggatgtcacagatccagaatccataaaatctgcggcaaatttactgctcagcgccaatacgacccttgatgtactgattaataatgctggtgtttttctggattcaatccaaaaacccagcgaaacctctctggatgacatccataaaagtctgacggtcaatttggttggcccctggctcgtcacccaagcatttttacccttactcaatcgttcagaagaagctcgactcatttttatatctaccgatcttgccgcgttatcccaagctgctgacccgcattcaaaatataacagaatcgaaggtccagcttatcgagcctccaaagccgctctgaacatgctcgcgttacaatgggcgaaagaatttcgtgattcgaagatttctgtcagtgtatgcagcccgggttggtgcagaacgggcttagatagccaaattagttcagaacaggcaccaaattctgctgccgaaggtgctgatacggttgtttggctggccttagataagggcagagaacaacacggccatttttattcagctcgccagactattgattggtaatgtcctaagataaaaaatgtatggagataacatcatgacaataaatgaaaatatcgatatcaccgttcagcaaactgaaacagcgtcctatatagacaatctggttgttcagggaaaaatcgcccaaaaagaattggaaaaacagtcagatgaagatattgataacgttcttcaccatttggcaaaaatattttccactcactgccgggaatgggctgaaaaagagcttgctgtgacccgtatcggcaatgccgacgataaagaacacaaattagctttggtagtgaaccaagtatttaagggattatatggcaccaaaacccatggtcgtcttggtggaacccaaaggcttattgaatatgccagtccagttggattgatctttgccgttgtcccattaacaaatccgattccaaactcgcttttcaagatcatgctttccatcaaaactcgcaacgccatcattttcagttatcccggtaaaactggcaaattggcagatgaatttattggtctggtacaacaggttcttaccgagcacggattgcccgtttcattggttcaagtctgcacgcctccaagccatgataaaacccatatgctgatgcagcaccccggtgtagacatgatccttgcgacaggaggaagaaatctggtgcatgcggcttacagttctggtaaacccgcgtttggcgtagggcctggcaatgtccctgtctatatcagccgttccgctcacattcagaaagctgccgccaatattgttaatggcaagatatatgataacggcatcgtttgcggctcagagagcaacctcatagtacatcctgcaagcaaaaatgacctgatctcggctctggaagccaatggtgcggcaatcttgacaagcagcgaagttgagcaggctatccagacgttatttaatccagaaacccagtatgtaagccgtgaaaatattggtgtctgcgcggcatctttggctgctaaagccaacatttcacgcacttatcccattaaattgcttgttatacccgcagaaataggcaggcatgattttctcagcaatgaaaaaatggcgccagtacttactctatatactgctgatgaagaaaatggagtttctcttgcctattcgttgatttgtaacgagggagcagggcatacggctgtaatacacagcgaagatccagaagaaattcatcaattttcaaccgtcatgcctgccggacgcattttggtgaatacatcagcaacacagggcatgctcggggaaaccactgagctacctgtatcattcatgcaaggcagtgggacttttggccacaatcattcaaccgatccgatcatctggaagcacttagtcaatatcaaacgtgtcgcacacggcctacactgattttgctaatacttgcgaatttacgtaatttgggaagtagatataatgaagatacagtgtattggtgcaggccccgcagggttagtgttttccattctggcaaaaatgcaggatcataaccgtgatgtcgttgtatacgaacgtaacttatcaaatgttacaacgggttgggggcttgtactttctgagccgatgttacagcagttagccaatatcgatcccagtattgttgaacagctcagacctcatatttcaacattaaaccatattgatatttatataaaagaaaaaacgttccgttcatctggataccaattccttgcgatcagtcggttagaaatgatcaatacccttaggaaaaaggcactggatctgggtatcaagattaattacgactcttcactgaatgctgaagatcttattaacctccccgctgatttgactgttattagtgatggcgccaacagtaagataaggcatcagttaaaaaatgaattcgacactaacattaatgaaggaaagaacctatatttatggttaggaacttcacatctatttaacgatacctttaactttattttcgagcagacagaaacgggttggttttgggcacattgttacaaatttgagaataatcattctacatttgttgtcgaatgtactcatgaaacttgggtaaaaacaggatttgcacatatggatgagaaacaaaccattgcatttcttgaaaaggtctttcaccgacatttatgcggccatccattgcaaatcaatgatacgtgccgtgaaaaagcctattggcggcgttttgttacaccagtcagcaaacactggtctcacgataaaaaagttttattaggaaatgcagcgcattccgcccacttttccattggttctgggactaagctagcaataggtgatgccattgctctggcagaaaatctgaaatcaagcaataaactggactcagcctgctttacagattatcagcacaatcgtcaaaatgaatcatctaatttacatattgcagcacaaagttctcaatcttggtttgaaaatgttgaatcattaattgaaaatgacccattagaattctctatatctttgcttttgagaagtggtagactatcacgcgatgaactcaccataaacctgttataataaggttttcaaagaatcagatttatattttattcatctttttatatcaattgaaatagtaaatgggagtcaccaatgaattacgcaaaaatttcacctaaaataatgaaccctctgtataaatgttatgatgaaatacagaaatgtgaattagaccaatcacttattcttttggttgaaatgcgaacctcacaaattaacggctgtgcttactgttgcagactccatgcagaaatggggcgtaaattaggtattgaggaagaaaagctggataagttacccggttggtttaactcccgtatttacaatcaaaaagaagtactggcactggaatggtgtgaagcattaaccattggtcttagggacaaagatcttaatgatcttagagaacgtcttgaagaattattttcagaaaaagaacttgttgatctgacctcagccatatcagtaatgaatgccttaaacagaatggcaataagcatcggtgatcacagctaataaattatagttcttttgataaagatagttgcttgattaatctgttgaataatatgtttcctggattatttcttccaggaagcactataatcataaaattcaggagaagcctatgttaaacggaactcaattaagatacgcggctttaatcgcacgttattcacttgcgattgcatatctggtcgcagtagctgacagatttggtttatgtggtgaatatggagatccacagattacgtggggtaatttcacggtattccttggcgttgttaagcatttgaccccttgggcacccgattttatgatccctatttttggttggggagccactattcttgaagttgctctacccatattcctaataataggttttaaaatcaaagaaaccgctttagtcagcgcagccttgttgttaatttttgctgttacaatgacaacgactggcttacttaaaagcgtgtttgactatagcgttttatctgcattttcctgttcacttctactctactgttttgaaaaattcagagtgagtgaagataaaaagcaattaaattaattttccttagtatacgtcagagcaacatccacttcctatggtattgattatataaatcagtaccattctacttatagttatttatagaaactattccaattatatttaattacacttagttattacaatataaattaatatccccatatcaatttttaaactaaaaatataacaaaaaacataaaatagcattaatattcaaaaagataagaatcacatcataattaataaaaccctataagttttatttcataaaattattacaccttgacattacgcatatgaattactttaataatccaaaatatttaattcaactaaaaataaaatattttaattagaaacaagaataacaaataataaaagagtaaaaatttatgatttttaatcaaaaagaaatgaatataattcaagccagggatttcatgaatgaaattttggtgtcaaaaacaacaacaaatattttaagacaaatgatacaaaaagatacagttatcaaaagccctattggaacttatgttggaattgaatcttttatagcactattgaaaatttggcacagagcctttcctaatttggtatataaagaaaataacctttacgttcataatgaaaatattattattgattgggaagccgaaggaaaacatcttggtgaattttattcaatttctgcgacaggtaaacaggttacttgccagggaacaacagaaattgttatgaacgatggaaaaattatcgattaccatacaaaaataaatattcaaaatattatttcacaacttataggtttaccctgctctccaacacttgatataagaaatatcgaaatatataatttaattaataatatattaggatatcagttatcttgcagacaaatagaatgcctctctctttccactctgaatacatcaattaaagagatagcaagattattatctatagaaagcaacacagtgaaaacgcacttaaaaagggctttcgaaataatcggtattagcaataaaaaaatgcttatggaatttattattgaacgccaagcaattgaaatactggttcgattaggcttatttttaagagttcaaataaaaagaaataattatttcgaataatggaataccagagaggggctcaatccaaatggggcgttctgattaatcgccaaactaaaagcaccgatcggactgagttatgccaatcataacatcgataccacgcagtagtacaaaaattaataataaattcctgatcaatactcatattaccccgctaaatatttaacatcttttttatcactagcacggaaacaaatataagaaagtcgttttagtgctttcttttttctaaaacaaaatgagatatactcacattgccatcctcatcaaactcccccaaacccagcacaacgtgatcaaattctccattccatattttttaaacagtgttccatgatattattttagataaatataattccaattttattattggctcacaagagatacagccacatactattttttgaagataaataagattttctatgcattctaatgcgatttgttgtttatttaaataaaatttattagcacctctttaaaatgaatcagtgacctcacctaatatagatggaatatattctgtacgacaataaaaatttgcgttagggtaatctttcattgcgcctataaaaactgaaatttttgcattatcaagcattgcgtaatcgttttcatcattaccaaaaactatagcattattgaaatcgacacccaatttacagagggattggtacttatcttcagattgaggtgttatatcaaataggttatctgccttatgatggttaatattgtatttaaaaccttcacgttcaagaaatcgatcgattttagttctgctttctccatctaataccaaaatttttgttatcttttcacttaatagctctttttcttctttctcataagtagataatgtcctcatatagttgtggaaatcatgatttatttcagaaacagaaaaataccatactccatcaataacgtatggtatcttttcttctttcaagaatgcaataactctagaaaaatgttctggattaaaactatgtgaaaataaaaaatcaccattctgccaagccatccctccattacacccaatcataagacaattatgaagttcatgcggtagcaacggtagcatatctctgataggtctggctgatgcgaaaataactgaaccactactacataattgttttattttttcggcaatcacattatgtattggttgtccattagtaataatggttccatctaaatcaaaaatatatgttttcattctcagattctcataaatagcatcattgtatgtaaaatgaaaaaaagataacaaaaaaaatggaaggcaacaacatattatgcgaactagtttagttatattcaaattaaaactaattgtggattaattttctgtaaaataatttcattaataaatcgatgagctaagtgatcaattttatttattaaattttttcgggtatagcaatttttgaaaaaaatttagtctgatttttgtttttttgattcttaaatgcttacgactgtaggtttaggtttcctctctcaatcaccagccttcccccacatcatacagaataaaaatttcttccggcaaaccttgcgatgaatgctatcgtgagtataatgcgcgacgatttgctgggagaaaatatgaaatactgcaccacacacgatgttacaaagcatcaagctaacgaaaaactgcctgctggcagcttgggcgcattatttttcccattgcaaaaccgatcattgaaaaagcccctcatttgaggggcttttttttgcctggacaggcagggctatgagtaaaaagaggaacgtaaacatggctaatccgttatatcgcaagcatatcatttcaattaatgatctgagtcgcacggatctggaattggtattgcagacggcagcagcattgaaagccaatccacagactgaattactaaaacacaaggcgatcgcaagctgcttttttgaagcctctacacgcacccgcctctcttttgaaacagccattcagcgactcggcgcttccgttgtcggttttgctgatagcaacaatacttccttgggtaaaaaaggggaaacactggccgataccatttctattatcagccagtataccgatgcaattgtgatgcgccatccacaggaaggcgccgctcgtcttgcttctgaattctccggccatattcctgtcattaacgccggtgatggtgcaaaccagcacccaacccagactctgctcgatctgttcaccattcaagagactcaacacaagctggataacctgaaaattgctatggttggtgatttgaaatatggccggactgtccactcgttaacacaggcactggcaaaattcagcggcaaccatttctgctttatcgccccggatgctttggccatgccaagctatatcctgcatatgctggatgagaagcaggtcagctacagcattcaccataattttgaagatgtcatgcctgaactggatatcctctatatgacccgtgtgcagaaagagcgtcttgacccttccgagtacgccaatatcaaagctcagttcgtgctgcatgccgctgatctggttaatgttaaagagaatttgaaagtgctgcatccactgccacgtatcgatgaaatcaccgtagatgtcgataaaaccccttatgcctactatttccagcaggcaggtaacggcattttcgcccgtcaggcattgctggcactggtattgaatgaaaatgtcgtcatagaaaaatgatgagataggttagtttgccgccagcggcctttcagcgcaatggcaagatgatcgaccagcagaaactcaccctagcaacgctggacgaatctgataacgcctcctgattggaggcgtatttctcattgagttacaaagaattatacaaggcgctgaggttccgcttcacctatctcagtcagtgataatttaaccggcacagattttgatgttggtgtgcccgtaccattgccaatactatccatcggcactaatggattggtttccgggtaataggccgcaaggttcccgcatggaatggcgtaaggaaccagtttaaaaccatacactttgcgctcaataccatcattccatactgtctcgatatcaacccgatcccccgcttgataccccaataaagcaatatcttctggattcataaagagcacctcccgctgaccataaaccccacgatagcggtcgtccaagccataaatagtcgtgttatattgatcgtgagagcgtaaggtttgcagagtaaacggaacgtctgtttcgcccagttgcgggaagagactttccggcagtgaagcatcactgaactgcgcctttttacttggtgtagaaaaacgtaactccgccgctgcattaccaaggtagaaaccgccgggctgttcacattttttattaaaatcagcaaaccccggaatggtcgcagcaatgtgatcgcggattttattgtaattcccggctaattctaaccagttaatcgttgctgtatttcctacaactgcattggcaatgcccgcaataatcgccgtctcagaacgttgagtatcaaataaaggtttgttcagcccttctgaggcatgcaccatgctgaaagagtcttctaccgtaataaactgcgctccactgagctgaatatcctgttcagtacgccccaacgccggcaggataagcgcctcttttttaccggtaataagatgactccgattaagttttgtactgatatgaaccgtaagatcacagtgccgaagcgcctcttctgtgcgcgggctatctggcgcagccgccgcaaggtttcctcccagagcaatcaatactcttacttcatcacgcagcatggcactcaatgctttcacaacatgatgaccgtgggcgcgagggggttcgaaaccaaaatgttcagccatgctatcaaggaaagccttcgtgggttgttcattaatccccatcgtgcgattaccctgcacattactgtgaccacgcaccggacacagccccgcaccgcttttacccaactgcccaaacagcaattgaaggtttgcgatttcacggacagtatccaaagagtgcttatgttgagttatccccattgcccaagtacagataacccgatccgcatgctgataaatggtggccgcctcacgtaactgtgcctgcgtcagaccggattggttctcaataaatgcccattccgttactgcaacttcttgcaaataagcgtccacaccttccgtatgagtcgaaataaattccagatcaaaaatacctgatttgccagccgccagaaatgcgttgtgagtttctaacagtgccttgaccattcccctgaccaccgccatatctccgccaagtttgggctgataataacgatggctgatagcgcctgcctttggggtaatcacttcgagcggcttttgtggatcggcaaaacgttctaaaccccgttcgcgtagggtattaaaggtgacgatccgagcgccgcgttcagccgcatggcgtaaactgtgtaacatccgtggatggtttgtaccgggattctggccgaaaacgaagatggcatcagcatgatcaaaatcattcagccgaatggttcccttacccacacccaaacttttcagcaggccgtaaccactggcttcatggcacatatttgagcaatcgggaaagttattcgttcccaacacgcggccaaacaactgataaagccatgacgcctcattactggctcgaccggatgtatacagctctagctgattagggttttccatcgccttaatgtgtttggctatcaaggtaaaagcatcatcccagctaatcggttcatagtgatccgtctgatggttataacgcatcggttcaacaacccgcccctgatattcaaggaagtagtcactctgttggtagagtttactgacgctataagccgcaaaaaatgcctgatcgacatgccggcgagtcgcctcccaagtcattgccttagccccgttctcacagaaactgaacaggcttttgttgtcatctccccacgcgcatcccgggcaatcaaagcctttggctttgttcatgcgcatcaggttaaccatattttttaaggcttgtttactatcaaaaacaaaacgtgttgttgcctctagtgaaccccaaccacccgctgcggagtgataaggttctatttttgatttgaatttcataaaaatctctatttttaacctagtggtcaaaaaattggccacatgatagcaggtgaaccaataacaccgagttggcttattgaaggataaccacggttttaatcataggagagaatcgagcagtaatattcatgatatagctataatctaaaccgtgatttcttctttaataatgatccattgtgatacttattccgttcttaggcaacggaaaaaccgatctattgctattgagagtacgatgtcagctcctcaaattaaccatactatttctattggtaattttataggcaactgttttataactgactacgaatttgggatgattttcgtgatgcttacgataacgattgagacgtttaggcctcaaggcgttacttaatcaattcaaagaaaaaattaatttaaacaatggattattattatagatggtagattaaaataataatttcaaaaattaaaattagcctattccattaggctctcattatttagataaatatcaataaatattttagttaaataaaaatgagtgatatttatcgtagtacaacctcaattacatccgccccacaataaagtacacaaaagtccccacatagttgccaatcacataaccgactgtaccaatcaccataatcgggccgaccagattgacccagccgcggctaattgccatagcggctgccgttgttggccccccgatattggcgttacaggccagaatgttctcttccagactaaatttaaacacttttcccgcagcaaaggtcagtaacaggttgatcatggcaattacaaaaacaaaagcaaacagcagtggtgcatggctaatgatggcttcaattgatgccggaatgccaatcacgacaaagaacatataaatagcgtaagtccccaattcctgtgtgccattcagtttgctgaatgtttctttaaagatcgagacgagagtaaacgtcacagttgtaaggatcaggtatttatcggatatcaaactgaaaagcagttcctgataaatactgtttggttgccccagcagggcttttagccatgtagataactgaaatgacagcgcaacgataaaaatcgaccatgccagcgataaggcgatatctttcagagcgatatttttcggcttccaataagcggctgcaaaagtctgggatttatccaagtctggatcgttatctatcgcgtcagtatgaggactgccccagaacttcctggctactgtccagccagataatgctatcaggataataaagtaacctgccatcatcatattatcggccacgatagtggatgccgtcatactttgggaaggttccagtttggcggccattgccgcaaagttgaccccacctcctgtatatgaagccgaaatcataccgctgattttatccagttccgggatatgctccttaaaaagccggaaagaaactatcgcgccaatcatcgtggcaacggaagaaatcaaaaataagatcagtaatcgccagctttctttgataatactgtgtaaattggttttgaataacagcaaggggattgctaatggcacgatatatccccaaactgcatcgtaaacaggagcttctgtcggaatgatatttaagttagacgcgaatactgcaatgatcagtgcgataactgcaccgggtattttagatgcccatcggtatcgctgctctaccataattgccacagcaaccgcaatcataataaaggcccaaagcattaatgaattatcagaggtaattaaagtattgttcattattttccctggtgttgttcaagtcgataaaataatttttattttgtcatttattacataattaacgatttagttatctgtttcgcgttccatccacagcaccataaatggcaatatcgtttttataaaatgcccacagggaattgccgtaatcataatgccaccattccgtaggtaagttagtaaaaccaacctgaatcatggcgttatacaataaccgacgatataaaatggccggcatatttttttcgggttctttttctaacgccgccgtataagacagctcagtcacttcgtcaaattcagttcccagaaacaggggcttgccagatgccacatcaaataacgtcacatccacggatccccccgtcagatggggactgatttggtgctgttccgtaggcgcaggagccacaaactgctgcaaaagtgccttttgttcttcaacagataaatggcgatattggtcagctatttttatctgtgtttgctcctgtaatgcctgctgagtttcccgtgaacgccagccatctaataccaaaagccctaaatgaggaggtagcagctgtgatgcaatcactaattttcgggcgacattttctcttacggtgcaatattcaatggagccttttataccagcaaaaaaataagcagattgctgtcttaatttatctgtatcagtaattatctctaaaggttcatgacattcattgataggcattccattaattacttcccaatcaaaaagtttttcaacagcgattttatccacggtgttattttccatagcaatagatagaaacatattcgcccttatactgtcatatttgaataaatagacttttatttgttatttttaaaatacgaattaaatcgttagttttactttacaaccaataacaatatatttacagattagcaacaaaaacacatcccatcaattcttattttctacatattcaaataactaaaatagtctattaaattaaacagataataataaatcatgtgtttttctaatattattgagacaaataagtggggcttttaattaatatttttttattccatccgctatcgttcacagctcaaacaaggtatcgctggatgcgtcaaagaccgatttatgcagggtgaaatgccaaatcttatgtgacagaataggtacatgcccttgatcccctaatatccggaggaggaatacctgaacggtattcatgacacaacatgacccaagaccatcaattacaagtagaagctattaaatgtggcaccgttatcgatcacattccggctcacatcggtttcaaattattgtctctgtttaaactcacagaaacagagcagcgcattaccattggtttgaacctgccttccaatcaactcggcagaaaagatctgatcaaaattgaaaatacctttctcacagagcagcaggcgaaccagctcgcgatgtatgctccccatgctaccgtcaataatattgaaaattacgaagttgtgaagaagatacccatcaatttgccaaagcagatagacaatgtcctcgtgtgtccgaacagtaattgtatcagtcacaatgagcccgttgagagcagcttttatgtcattccaaccgccgatgatgtgatagtccgctgcaaatactgtgagaaggaatttgaccgtcaggcagtcattaacaacgactagcattctgccaagatgaaccctatatccaagggatttcaagacgaagggtataagctgtcctgtaccagttgaagcaggactggaggtcactataatggttggctctcatattttttcattcagacgttaaacaggagtttttcatgtcacgttccattcataccgagaatgcaccagcagcaatcggcccttatgttcagggtgttgatctgggcagtatggttatcacttccggccagatccctgttgatccaaaaaccggtgacatccctgaagacattactgcccaaactcgccaatctctggagaacgtcaaggcgatcatcgaacagtctggtctgaaagtggctgatatcgtgaaaacgacggtatttgtcaaagacttgaatgacttcaccaccgtaaacgcagcttatgaaacgttcttcactgaacataacgcgccattccctgctcgttcatgtgttgaagttgcccgtctgccaaaagacgtgaaaatcgaaatcgaagccattgcggttcgcagctaattctctgctctctcagctctgatagcttcagtatcagagctgtaatttcctcgatcttatctgccatcagcgcggcaaaataacttattctttctttatattagatcaattttttactctgacattaacgttgccaatgtagttttttgccaaaaccaagggtgttatccaccatttttatttcacttaggctgagtcgccagataggggattttgcagcgagggcgacgggaaaacgacggcaataacgtgctctggcaagagtttcggcttcgcctgtcagcggtgtgatttcaccacggaattgaatacctttgatttgggcaatgttacgggtttgccctgcgacagtgccggcaactactggattttgctgcatcatctggccgtggcgggtatccggttcggtcataaaccagaatgccatactatcggcatcaaacgcatagaagcaactcgcacaccatagatcttgtgatgaggaagtgcagagagtgaagacatgttgtttggcgagatatcgacgaatagttaagaaattttcatttaattccatatagttccatacctattatatttacctgttcatatcagaacacaactggatattcagccagccacgtgttctgatatttatataatcatgcagggtcagtatggatgcactataaattatttatagatttcagcaactccactgagtttattctgaccatttgctgaaataacacggaaatatgatgcacccgctttatcagcttttttggataactcagcagtcagactatccagtgtctctgcaccagtaactgaaacaaccccaaccttctctcctttagcatattgcacttcagttgcagccatagagccaaatgaaatagcacttaatgccaaaatacagacgatatattttacagatttcatctttcgatcctcagttcacttttaaattaagggggctatctctgtgatgtggatcatgttatacgcttcttctgaaaatgataattagcaattattgctgtactatttcaattattttgaacaaataatactgtaattccatgccagatagaatataatttaaaataattcattaagttatcataatataaaggtaataatttaggttatcaccaaataatgaatgagtttcataggataataaaagcatgcaaattatttaaaataaataatgatatgaaatcaacccactggtatctctatctgataagaactcgaaacaattctctgtatactgggattaccacagatatcgcccgtcgatttatgcagcacgtgtctggaaaaggtgccaaagccttaaaaggaaaagggccattaacattggtctaccacagtttggtggaagatcaaggcatggccctgaagttggaatatcgcgtgaagaaactcagtaaaaaacaaaaagaaaggctgatcactctccaacctgtctgtatagcaacctatttgtccgagatgttggtgccaaaaatagctcagtcagtcatcactcatgatcaaaatggtcggaatacgtaatcagaccgtgacaatcttccagtgagacatccgccaacgtgtatatctggaagtgatcctcacactctggccattggcaatgcaattggtattctttggcaagcctgaaaccaaaacggcggtaatacgcaggctcccccaatacaacaaccgcgccatagccaaattcatttagactatccagcccttcataaaccaatttttcaccaattccctgacgacggtacggttcagccaccgctaatggcgctagcccaacccattgatgatcctgaccattgacatcaacagatgtgaaaccgacatagccaatcacataaccttcatcgtcagtcgcaacaatacccaacgtcaacagaccatcttctctcaatcgataaactaactcagcttctgccgatgtctcaaaggattgacgtaacaagcgatcaatacccatggcatcgaccggaatttcgaccctgattaacatgacgataatgcgcgatcgtgctgatcaacgccctctttttgtcccgctttgataaattcagccagacacaataaacccaagcggagaatggatggcatggatcccagcctaatggcatccaccaaatttttcacatgcagtcccaattctgtatttccttcaatccttaaacgatgctgaaaaaacagtgtatcaggatcttccctgcgagactccaaaaacgccagttctccctcagccaataccccgtggaactgccagccaagcagttgttccagcacctgatgcggtaaagcaaaaggagtcaccttcaatgaaagacgcagtaatgttggctcttgactgactaaatgggagtggattttacctaacacagttcagactcctttttcgtgaaaagtaacgcgcttacatcataagcctattttttatccttcgaaagaaggataaaaaataacacagtcacattcaaaaaaatcaccataaaccatgcaacccaaaaacctagaaaatcagacaatacacccagcaatacactcaatccaacagaaagagtgataaatatcatttcattgaatgataataatcttcctagaatttgattacctgcttcattcataataattgtatttcttattacccgaatacgtgagtgacttaacgcaattagaaaaagacacaaataaacagaataaaggtgattaaaaaaaacaggtaaaaaaagacctattatagagatagttccgaatatgatatagttattttttagtgacaaatatgatcgctttgagccaatcaaactacccattatagcccctaccccatatggaacaactaacagcgcgtaatactgtatctgagaatttataacattaaacaaagcagggtatattgaatttaatgatacgacacaaatatatggaaatattgacaacagaacaacgtgtctttttacttcaccattaaagaaatcatatcctattttataagtatttttaattctactattattttcaataacacgatcaaatttatctgtattatcttttttaacacaaacatttataaatatagaaatagaaaaacaaaaaatacttacaatacagacattacttatcgatttatcttctaaaataaagaaggccacaccgccagacagaaaagtaattccctgcctaattaattcaaggtttttattagcgttataaagttcttcgctagaaacaactctttttatgtaagttgctcttattacctgatcggatgaacgaatgaatgtaaatatacttgtaagtataataacggtggctataagaacaatttcattcaaatttatatttgttaaaaataaaaaaacaacgctatttaaaagacctagaatataaatattatttaacgctttcttagcagagtttgaatcaataaaaaaacctatttttggcagaataaaaaaagtcaatatataacctgacgaaagaacaacagatactaacgttgttgaatgaaaacttccctctacaaaccaagagatggcagtaaaaaaaactgccattgatacaccagatgttaatgcagatattaatattgggatcatgttaaacaccgaaatagtctactcgttgtcgaggtatataattcccttgctttgtataatactcctctatttctaagcattgcaagtcaatagcatgtttaatatcatgaattgcatttagaacatatgaaactttatcaacatcattgaaattaattagtgatttagctttttccagaagctgagaatgcccaagttcataatctatcttagagtgctcaaagaaaggttccagcgtaccttgtttaaggttatacgttttattaatattatcaatagcaatctttacttcattttcatcataatcatgagattcaataacttttgccaccagaaatacagattcaggatatttaccaaacaaatatttcatcatattaataagatttgaagtcgagactaaaggaatcgacgtttctacttcctcttttctcattcccatttttaataaacatctcaacataaatatttcatgtccagcttcctgtaaccgatactcttccaatatatttttcacactctcatttgtcgtgttttttatagcagaagatattgtttccggaaataatttaatataatggtagttttccagcataaaacctagcaagacattatagctcacgtcaccatataaaaacttattgaataaatgtgtctcttctatttgctctgcccacatctcacaggcaataatgatcttatcaaaaaaattttcttcactgacaatttcttcattccttaacattcctatttcatgaagagatgaaattatgtcaactattctatcttttggcattcctgttttttcatgaatatctgttattgtattattcccagtgcaatatccgcgtattgtcataaaatctcttgcatcatttttgtctacttcatataaccctttggtaaaacgcaagtaatattcatcgtcttcattttgagtccataaattatgaataaatttaggtgtttctaaataattcttactagccataatgaggctcctagattaaatgaaatatagagccagcaaatatgctggctccaactcaaaaaattagccgcacattactccacctaattttttattactttttttacttacttttttcatgttcataagttatctccttggtctagtttgattgtctgaaccaatcagacaattgtacattacttatataaatttcaaagatcaaaccagatttaacattttgttaaaatttaagatacagatcacaaacaaatgtaatgcttatattaaaaacagcatcactattaaatatataataatcagaattagtgaaatcatttaaataaataataaaaacaaataatgactttattttataaatttcattagaaaaaattcctgatacgaaatggaatattacgcaattcctcattgacgcgatgtaacagatttccacttcaatctattgattaaagccgaccctatagtacagaggtcggcaaataatatgctgggggagagtttaatggaataattatcgtgattcagcgttgctcacgcatagatggaataaccatttgccagacaagggatacgatagccaatacacccgtcactgcccctatccatgttaatgtttctaatccccactctcgtactgtcgcgccaccaatcacagagcctaaaacgaccccagcattaaaagccgcgatattcattcctgacgcgatatccattgcatagggtgtgtgacgtttcgccagcatgagtatccttgactgcaatggcggaattgctccataagtggccaatccgagtagagccgtcaagccaatcatcagtagagaatgggtcagactgaaactcatagcggcaagcacaaccgcaataccgacaagaagaatcagtgatgcgagatccattccttgtcgatcagtcaatcgcccaccccaaaccgtaccaacagcagcaccaataccataagcaagcaatactccactggctgtttcaacacttacccctgtaatactcagtagtataggggtaataaaggtgtacaaagcaaaagaagcggtataggaaagcattggaacgctcgcccctgccagtaaacgtcgatcaaaaagtatggttagatggcgccagctagcagatgtcttcacaatctgttctccggcatcttttggcattttaaatccaataccaagcgttcccagcaacccgcaggctgagataattaaaaatatcactcgccaatccaatatactaccaagccaagttcctgccggcacccctaaagacatggcaatggtaacaccaccgaataccaaagcgagggctgttccggcacgttcagatggaaccagccgagtcgcaacaccggaagccacagcaaaaaagaccccgtgtgccaaaccagataacaaacgtgcagctaaaagaagagccaaatttgctgatgcagctgctatcagatttccaatagtaaataccaacattgcggtaagaagtaagcgtttcctcgaccaattagatgccagtgccgtcaaaataggtgccccgatcacaacacctaatgcataggctgtcaccgttaacccgatactggttacatctgcgtcaagatttgctgacatcaccgatatcagcccaatagtgatgaactccgtaaaccctatcgcgaatgcacaaagcgaaaatacgtatatcacgaatggcattaaaaattctccttatacgctcaaaacgcgccaacctgaattcaaagtaagtcaccagtatcaggcttccatttagtgcaataaatattcataatggataaaaacttatgataggacgtcactagtggtacttcgtaaccttgaagatctaagtgtatttatcagaatcatcgacacaggcagtttcactgctaccgctcaagccttgggactgtctcccaccactgtcagtaaacagattgcacgtctggagaaaaatcttggcgtagttctctttgtacgaagtacccgttcattgcgcattactcctgaaggcaaagcaatcgctgaaaaagtgagggcggcgctgacactggtggaagaagcgactgaaattgccaaggatggaagtgaatctctcacaggtttgattagacttaccgcgccagtaccgcttggtcgaacttatgtcgcggcagcaattgcagagtttagaaaaaaatatccatcagtaggattcatcttgcatttgacagataaaattgttgatctttataaagttgagatggatttagctatcagagtcgcaaatttaactgattcaggtttaattgccagacgcttaacagataacaaacgaattttagtcgcatcacctgattacctcagactgcatggcgaacttcagcacccagaagagctgattaaccatcattgcctgcttttttccgcctccggaaataagagtacaatatggtcactacacgataggaaaggcactaaagctatctcactctcaagtgatttaatcgctaataatggtgatgtcttgcgaacttggtgtacggcaggtttaggtatagcactgcgagaaacatgggatgtagtcgatttaattcgcgcaaaaaaactcatccagatactgccggaatggcaagaagaaacctcgccaattaatctagtgagagccgggaaacggcctgttccgcagcgtatcaaaagcttcatcgagtttctcaccgaggaatggagaattcccccgtgggaaaaatagctgaacaagccggtaaactgataatcatcccgacttgttcctgccatcttacaaaatactttgaatgacgccaccatcaacacgcagggcagtacccgttattgcagaagcgagtggtgaagctaaaaagagaacagcattggcgacttcttcagcagtggctaaccgacccagcaacgatgcgggacgtgctgtttcaataaagcgttttcctgcttcttccattgaaagtgttgggtccgtgataagttctctgacaaatcgctctaccccttcactttcagtgggtccaggtaaaacgctgttgacagtgactcctgttcctgtagcagcttgtgcgaatcctcttgctgctgcgacttgagccgtcttggtcaggccataatgtggcatttctaccgggatttgtaaggctgactcacttgagatgaataccacacgtccccatcgtttcccaatcataagtggaatgtatgaacgtgccagacgaattccacttaggacattaatattaaaataattaatccattcatcatcgctaatttcaaaaattggcttaggagaaaaaattccggcgttattaaccagaatatcaatatccggaaaatttttgttaatgagttcacagccttctttggtgccaacatcagcagctacagtaaaaacgcgatccaagcagttaaatttattaaccgcctgtatgagcctctcttcacttcttccattcaaaatgacagaagcaccagccttatgcataccctgagcaatagctaatccaatccctgctgtagaacctgttactaatgcaattttcccttttaaatttatattcatataaccctctattcatcttctgtcagccaaaatgagtcttaacctattttttaattagataaaaggagtcactccgccatcgactaaataatttgccccagtaatgaatgcagcagattctgaggccaaaaataagagtaaaaccgccacttcttcaggttgccctaaccgaccaacagcgatatcaacttcttcaatataacgttgcaatgcttcttcacgtccaactttatacttttgttcaagctgagttatcaatccttcaggtttatcgtagatagaggtatgaataaaagctggagaaataacattagatcgaatgccatattttccaaactcccttgatatcaccttagacagagttagaactgaagatttcaagatactgtaatcagggagaatcaaatttggcattaatgctgcttcagaagcgatatggagtaaaataccctttttctgattgcacatataaggtagtacaccgcgagccattcggatgtaaccaagcagattggtttcgattgtagaattccagtcgtcatcggttacatcaagaaaacttttcctcggttctactaatgcagcattattaatcaggatatctatcttcccaaattggctgatggctgtattgataagaccatcaatatctgagggatctctgacattaaactgataaggaaataggtattcccctctctgcaactcataaagtttctcaaggttaatatccgctcctataacatacgcccccgcatttaaaaattccgtggtagcagcaagcccaatacctgaacctgccccagtgatgattactgctttacccgctaaactacgctccatcagtatctcctacagcaacatctcgtttgatctggttaatatgtacaacgattcgtgcttgttttgcgacaaaataatttggcaccgaataggcaatagttgcgaagtcaaactttccatcttgattgaagtccgccgccgctaccgaaagagtaaaatataacatctcatcatgctgcccggtggatataagaattggatcaaagtgttcatctttacgcatttctataactttatgatattaacttaaatacatggaaatttgcattacaatataagaacttctattatgaattttcgtcatgaatatacatcacaagactctatataaaaataaaaaataagataataataaatggttatgaaataatgagatcataaatttaaaatcatcatatataatttagaatagaaacaataaaatctcattgatttaattttcaatttttggcattcattccttatggtgacatttctcaggtttgaagtatcttataaattatttttcaaaaaaatcgatcacctgaaaggaacttcgtccagttttacgggctactcagtaatccaaaatcactcaacggatcgcaagttatgacaatcgtagcgctgatatcccgatgaacgccccggatgaaaaatgatccagaaaacctagaatgaagatgacacatgcagattaatctccgtgtaaaatacctcactacaaaatagtcactatagaaataattaaacagcaacgatgtgtaacaataattaccatatcaatggtaattatttccaataaaaattaattaacatcggtattatttatttttattcaaaatagatatgcattacaaatgagatgatgaaatcaactatacggataatgactaatcatacagtaaaatttcatattacaattttatcactatttaaaataatgcttatataacgatttgacagaataaatagatgctattttgtcgtgttattcattccaatcagtatttcttactgctaatagtgtacttaattgacattaggacaatataaaaataaatatcatctgtgcattatcaaatttcgtgtaaataaatactgataattaccctatagaataatatcaaacaaatagttaatagctgggagtaaaattattttttataaaaatatcatttcttattccttaaatttatcgataccattagtgtaaaatagctacaaaaccggacagatcatggtgatcttccggtctattttttatttatgtgctgttagaatattcgccctattcaggcaatatatgttgttttcggaaaaaaattgatacgcccatttaaaagaaaaatgcaggtgtgatcatagagtagctttaaatttaatcggttatcaaggggcaggatatttaccactatcaattttcaattgttgattctgctgccaggctttctgaaaccgttctggattgctggcagtgtaatgcatggtgtgacgaatattacgatgccccaaataatcctgaatcagccgggtatctaatccttgattagccaattcaaacccgcaggagtgtcgcaacttgtgtgggtgcaacctaatggataaacccgcctgttctccgtatcgccccattaaaacatgaacccactgacgtgataattttccgccttttcgtgaaggaaacagccacaaagaagcgcaatataccgagttgttatttctgattttaagccattttaagataagttctttttctgtttttgagatagggtgtgttgtcgaaaatccattttttaaccgctttatataaatggttttccctgcgatatcgatatcggagacttttaatgaagtcaactcactcacacgtaggccatgaatataagttaagtatagcagacactgatcgcgctctttatttgtaccattgtttaatacagaaaaaacacgattccattcgtcttgtgttatatattttctcatgactatctccaataaagcgaatccagcactactttaattaaatacattctgtttgagcagaatgtcagcacaacaaaaatttttttatgttttccgttttatggcaataaacttccctctgatcaatgagcatcagtaaacaatggtttggagatcatttttcaatctgttacgtcaaaatttttagcttgagtaagtatatgacctatttgaaattttgcagaatataaataaaacctaaatcacaaaaagcacaataaataattataaaaagcaatgaacagtgtagtcagacttacataataaattagcaatattattttgtgtctattttttaatctcaaaaataacgcaatactcgttgtttgatcgtgagagataaaaaataattttaacctatgcgtcaaatagaacaattcatagacaaaattgggctgtctgccattggtaaatgaaaacaaaaattagtagcaattaatcacaccgttttaattgatcatatttatttatatttaaagttgtttttattttatcctctccaggatacccagccaattgagtaataaatacataactatatgttttaattaaattaattaaaaaaacatatctttaccatcaaaagatactcttcataaaaccatcaaatccttcttcttgatctccattatatttaatatgtttgctaacaaaagttatattgatcaaaaaatgattttatgttggaataaaaatctacatataagacataaatcagacaaataacccaatcattaactaattaatagattttgttaactgccttatgatgtatcaagtcagccaatgtcgtctggtcagcattctattttcggcattactggcgtttttttattgttataggtatagctatgcacagaaaattcgataagtcgtggccacagaatcagtatcctttgctgaaacgaatggcttgggcgaacattatcatccaactggcgtttccagtagcaggtacatttactcccattatcgccgcagccaaaacgcatacgacttctcacgatcaacaattgacggcactaccgataaaaccttatatcctgaaatccggggaaacgatcgatttaatagctaaacgttatagcctaaccgtcgatgatctaaaaaaaatcaatcaattgcgtacctttagcaaacccttttcaacattgggtatcggtgatgaaattgatgtaccccgacctcgcctcaataaatttctgccttgtaattattctccgttagacgaatctgacagcaaagatgagacaaatagccgtctgtctaatgccgctattcgcgttggcgatgtgttgaaaagtaatgacataagcaatagcgcaaaaattcagttaaacggtctcgcagtcagtgaagtcaatcagcagattcagaattggctggggcactacggcaccgcacgggtacagataaatataagtgatcggggtcgattagatggcagtcagcttgatatgctactccccctgtatgatacaaagaaccaactgacgttcacccaattcggcctgcgtcggctggataaacgcaataccatcaatctcggtgttggacaacgccgtttctttgacggcggaatgctgggatacaacgccttttttgactatgactttaccggagagaatacccgaatagggcttggtgctgaatatgcccgcgattatctgaagctgggtgctaatggttactttcgcttaagcaattggaaagaatcccctcttctgaccgattacgatgagcgcccggctaatggctttgacctgcggattcagggctatgtacctgctttgccacaactcggtggcaagttgatgtatgaacattacttcggggatgaagttgggttactcaatcaaaatcatcgccagaaagatccttctgccttcaccgtaggaattaattatacgccgatcccattgctgactttcggcattgatcggaagcaaaatacttccggtggtggagaaaccctgttcaatatagagttgaactatgaaataggtacaccatgggagaagcaaattgatcccgatgccacggatttcaagcgcaccctgcaaggcagtcgctatgatctggtcgaccgcaataaccagattgttctggaataccgcaagcgtgaagttatccatcttacaatggaccgtctgattaccggacatgctggtgatatcaagccgcttcaccttaccgtggtcagtaaatatggtctgaaaaatattcagtgggaagccgtaaacctgtttgccgatgggggtgagatcgagcgccaaggcggttctcattatctgctgactctgccggaataccaccatcagggcaacaatacttatattctcagtgccgtggcctatgatgagcacggcaatgcttctcagcgggtagaaactcaagtacaggtgctgccagccgcagtacgtgacaataagtccactttcacagcaaaagataatgaactgctggctgatgaccgtgccaccaccatgctgaaattaaccttagaggataaagagggtaagccaatccgtgatgttgccgacgatatcaaatgggttactaatcagttgggtggagaaggcagcgatccgacgatcggaaaaataaaagaaactcaaccaggtgtctatgaagccatactcacggctggaaaaaaaatagggatactaaaaattacgcctgaagtggatggagttcatatcaaaccattaaaaatcacatttgtgcatcctgacgcaccgtttgtcaaaaatctgactattgttggtaaattggagatcgggcaaaaattgagtgcaacttatacttttaaccctaatgggggcgaaaaagtggataaatcccgctatgtatggggtgacaaaggtaatatcgatattactaacagtcatacgatcgtcgaatcaggcaagctccctaactatacattggaactgtcagatgctggccgggtaaaagccgttgcagtgcaggcacaaaatggtcttggactcatcgggaatactatgattgttaataccagcatgagccaagagagtggcaaccgtactcacggcggcagtgaaggcggaaaagtcagagggattgcggatgatatcgctgccacagtgaatactgataatactaaaaaaagcaacacaataactttgaccgtacagacattcaatcacgggcaacccgtcagaaatgtggccgttgaggtgcaagcgacccaagcaataaaccgccagaataaacctcagacgattaccgtgctgataggcggcaaacctgctctttatcaaggcgtgacagatgagcagggcgtactgtctattcctatcaccgatccaaacgggaacggtgtaaaaacttcttttaagataacagcatatggttctgcaaaacctaaaactcaggagctcatctttaccgtcccgaccagccccgatacccctctggcaaacttttggggacatatgtccgaatcagtaatgggtgccaatggcgctgtctttatgcgccctcagttgcaagttgaactgaaaggaaagatgaaagggttggccacattttttgaaagcggtgagatatggccacgtcgggtttacaaaggcgctgaatggtactgcggaaaaatacatgccaatttgccaacacaagaggacttacagagcctgtatcgtgcatattcggcaaatgaaatgcacgatctgcacggctggccacaacatcgctcttatcgttcttcaacgcctgcagagggtaacaaagtgcatattgccgtgaatatagacaatggatttgcacatcccattgaggacaacattgtcagcgattatgtcatttgtcgtcagtaaaacaattaatatttgacatacacacccgcctctcaaaggggcggctcatcctctatcttctcaacagaatgactttctcttcccaatgtcctattgacgggcttaaatttaacctttgataatggcgctctaaatttatttataaaaattaatcacataatgaaaatagaaaaatatgcatgaatttaatcttgttttgttactacttcagcaaatgtgtgtctatttggttatcgcctggctgctgagtaaaacgcctctgtttatccccctgctgcaagtttccgttcgcttgccacataagctgatgtgttatgtcattttctccattttttgcattatggggacgtattttggattgagtgtcaatgattccatcgccaatacccgcgccatcggtgctgtactgggtggctttctcggcgggccggcggtcggggctatggtaggattcaccgggggattacaccgctattcccttggtggaatgaccgcgtttagttgtatggtgtccactattgtagaaggcatactgggcggccttgtacacagttatctgatgaagcggggacaaatcaataagctgctgaatccgtggactgccgccatcgtcaccttcctggctgaatgtatccagatgagcattatcctgctgcttgccaatccgttcagtgatgctcttaagttggtgaaaaatatcgccgctcccatgatcattgccaatagcatcggagcggccatgttcattcggatactgctcgacaggcgcgccatctttgaaaaatataccagcgccttttctgcccaagccctgaaaatcgccgtctgtacagaaggaatactgcgtaaagggttcaatgaggataacagtatgcgcgtagcaaaggttatttatcaggagttagagatcggggcggttgcaatcaccgacagggataaattactggcgtttatcggcattggctccgatcaccatttgtctggtactcccattgtttccgagcaatcacaccgtgcgatagaaaataatgaagtcgtgtatgccgatggtaatgaaacgccctatcgctgctctctcagcccaatctgtaaactcggctcggctttggtgatccctttacggggagaaaaccaacaggtgattggcaccatcaaactttatgaagctaagaattgtctattcagttcaatcaatcgtacattaggtgagggcattgccagcctgctttctgcccaaattcttgccggacaatacgagcggaacaagcaatctttgctgcaatcagaagtaaagctacttcacgcgcaagtaaatcctcactttttatttaatgccttaaatacgttacaggcggtgatccggcgggatagccagcaggccgggcagcttgtacaatatctttcaacatttttccgcaagaatctgaaacgaccagaggaaattgccacgctggaaaatgagatagagcatgtgaatgcttacttacaaatagagaaagcccgtttccgtgagcgtctccagattgccatagcgatacctgaatccctgcgctgcgcaaaattgcccgccttttccctgcaacccatggtagaaaacgccataaaacatggcacttcacagttactggatacaggccgagttactatccgagcccatcagaaagctaatttattactggttgagattgaagataatgcaggactttattgtctaaaaaaaataggggatggacttggaatgagtctggtagataaacgtcttcggcttcgctatggtgagcgctatggtatgcgtgttgattgccaaccagaaaaatttacccgtgtcattttatgtttaccattggaaaaagaaactgacaaagcagtgtaaatatgaatgtattgattgttgatgatgaaccactggctcgagagaatctgcgttacctgctagaagaggaaacggatattcaaatcatcggtgagtgtgccaacgcggtggaagcgattggtgctatccatcgcctgaaaccggatgtggttttcctcgatattcagatgccccgcattaccgggcttgaaatggtggggctgcttgaccctgagcatcgcccttatattgtttttctcacggcctttgatgaatacgcagtgcaagcctttgaagaacacgcgtttgattatttgctgaaaccaccggaaaaggagcgtctgagcaaaacgttgcagcgactgcgttcaggctatcagaagcaaaatctggcagatctgcaacaggaagatgaaccgcttaaatatattccctgtacagggcacaaccggatatggctgatgcagttagatgaggtgctgtatgtcacctcacgcttgagtggagtttatgtgatgagcgccaataaacaggaaggttttaccgagttaaccctgcgtacgctagaaacccggacttctttgactcgctgccatcgccaatatctggtcaatatgactcatttgcgggaaatcatttttggagaaaatggacaggcagaactggtgttacgaaataatgagcatatcccagtcagtcgccggtatttaaaaccactaaaagaagttctggggttaaattaatcatttttccgggcataatgtcttcaatattaaaaagccccttctctgttaggaaaaggggctttatcttcaaggcattatttcaatgcactgtgtcttatcagcttatgcgttgccgctgttttgacgacgacgtggtgcgctattgctctcatcaccactgcggccacgggaattaacacgatcgccacggcgttcagtgctaaaacgacgaccaccattaccaaaaccctcacgatcacgacgtggtgcattaccaccgttgctaccgttaccgccagtgctaccattaccgccattgctagcgttgctaccgttaccagtgcgaccactaccaccgccacgacgttcgcgacgttcaaacggttgtgcatcacccatcaactgcatattcagtggcttgttcaggatgcgggtacgtgtgaagtgagacagcaaatcccccggcattccttttggcagctcaatggtggagtgagtagcgaacagcttgatattaccgatataacggctgctgatatcaccttcgttggcgattgcaccaacaatgtgacgcacttcaacaccatcatcacgacctatttcaatgcggtacagttccatgtctcccacatcacggcgttcgcggcgcggacgatcacctttgtcgccacggtcagctctgtcgccacggtcgtttctgtcacctctgtcatttctttcacgactgctgaaaccatcacggcgacggtcatcacgatcattgaattcacgacgaggacgacgaactgggtctggtggcagaatcagtgggcgctcaccctgtgccattttcagcaatgacgctgccagcgtttccatatccagctcatcgttagtgctcagtttagacaacagggcacgatattgatccagatcgctgctttccagttgctgctgaaccttagccgcaaatttctccagacgacgctggctcagaagttctgcattcggcagttcaacttctgggatggtcagtttcatggtacgttcaacgttacgcagcagacgacgctcgcggttttcaacaaacagcagagcacggccagcacgaccagcacgaccagtacggccgatacggtgtacatatgattccgcatccattgggatatcgtagttcacgaccagactgatgcgctcaacatccagaccacgagccgctacatctgtcgcaatcaggatatccaaacggccgtctttcaaacgttccagtgtctgctcacgcagcgcctgattcatgtcaccattcaatgccgcagagttataaccatgacgttccagggtttctgctacttccagcgttgcatttttggtacgcacgaaaataatcgtagcgtcaaaatcttctgtttcaaggaaacgtaccagcgcttcgtttttacgcacgccatgtacagaccagtagctttggctgatatctggacgagtcgtcacactgctctgaatacgaacttcctgtggatcattcatgaaacgacgagtaatacgacgaatcgcttcaggcatagttgctgagaacaatgcagtctggtgctcagcagggatctggctcatgatgttctcaacatcttcgataaagcccatgcgcagcatttcgtcggcttcatccagtaccagacctttcaggttggacagatccaaagtaccacgtttcaggtgatccaacagacgacccggcgtgcctaccacaacctgtggcccttgacgcagtgcacgcaattgcacgtcgtaacgctgtccaccgtagagtgcaacaacatttacgctacgcatttgcttggaaaactctgaacatgcttcagcaacctgtaccgccagttcacgggttggcgctaacacaaggatctgtggagctttaagctcagcatcaatattgtgcagcaaaggcaagctaaatgctgcagttttaccactaccggtctgtgccatacccagcacatcacgaccgtttaacaggtgaggaatacattgttgttgaataggggaaggcttctcatagcccatgtctcccaatgcagcaagaataggtgctgataaacctaaatcagcaaaagagatttcagtctcagtggtcatgtaatggtgccttattaatcgtggcggccagtctacataacacagtgaaaagaatttctatcattttcatttaaaatgtgaactggctcaaattatgttattaaacgaacaaacaagcccccacctatcaagatgtggacttaaaaatctgtcatgaaaatgttcgtcagctattgttggttcgattccgataggtcatcttgtctctggcctagcagcgctaattccaacaatgcatagcggtgctcaacaaaattatggacattgttagctaccgtcagcttgaataacgcaaccgcgttatcctcatcccccagacttaggtaatgcttacctaaatagaagtcagtttcactgagatgctcagcgagcgaagtgttatctgatgaattctccttcaggcgatccatcagtgttttttcactgattttgcctaaatagaactcaacaatattccagccccatagcccccggttcgctttgtcaaaatggcgtgacaaattggtcattgcaaccttgggatcgattttatcttccacaaggtacaaccacaacgaacggaagggatcatttggatcgtcttgataaaacgcctgcagatcatcctgcgctaaacgatagcggccaccataatacagtgtaatgccgcgattcattcgcgcgtagttgtaagttggatcaagctctaaaacagaatcaaacgcttcataggcagcatcaaaattgcctgcctgcgtaaaataaatccctaaataattgaaaatttcaggaatatcaggacggatagacaaagccactgaaaaatcattctgcgccaatgccctcagcccgaggctatcatacaacacacctctctcatataaaagctgtgcatactcatcttctgtaagagagcgactggcaagtatttgttccatacgagccaggataacctcttgttgcaatgtcggttgtaatggaatagcaatcatttcatttttacgccatccagtgctgccacatcccacaaggagaaagataaccgcaacataacaccagcgcagaaaagaattcatttcctactcccgaagtcagacattaatcagaatgccctgttactccacccacattgtatatttcaggcgtcctgcccaaaattgactaaacggcgccctttttacaggacgccgttctttacgtcaaatttattctactgatgattctggtgattgtagtgcttcatcggtagtgatattggtcacagcttctttcatactcagacgaatacgaccctgacggtcgatctccagtaccttgacaggcacttcctgagcgagttgcagatagtctgtcactttctcaacacgcttatctgcaatctgagaaatatgtaccagaccttctttaccaccaccaatagcaacgaacgcaccgaagtcaacaatacgggtcactttaccgttataaatgcggccaacttcaacctcagcagtaatctcttcgatacgtctgatagcgtgatgggctttatcactgtcagtggctgcaatcttcacagtaccatcatcttcgatttcgatggttgtaccagtttcttctgtcagtgcacggatcactgaaccgcctttaccaatcacatctttgatcttgtctggattgatcttaatggtgtgaatgcgtggcgcaaattcagagatatcattacgtgggctttggatagcctgttccatcacgccaagaatgtgcagacgagcacctttggcttgattcagagcaacctgcatgatttcgctggtgataccttcaattttgatatccatctgcaatgcgctgataccatcacggctacccgcgactttaaagtccatgtcacccagatgatcttcgtcacccagaatatcagacagaacaacaaagttatccccttctttcaccagacccatagcgataccagcaacagcagccttaataggtacaccagcatccatcagtgccagtgaagcaccacagacagaagccatagaagaagaaccgttagattcggtaatttcagacactacgcgaatagtatatgggaattcgttagcggttggcattacagccaaaacaccacgtttcgccagacgaccgtgaccaatttcacgacgttttggtgagccgaccatacccgtttcaccaacagagtacggagggaagttgtaatggaacaggaagcgatcggctcgttcgcccatcagttcatcaataacttgggcatcacgctcagtacccagtgtcgctgcaactaacgcctgagtctccccacgggtgaacagggatgaaccgtgagtacgtggcagtacaccagtacgaacgtccagtgcgcgaaccatgtctttttcacggccgtcaatacgaggctcaccacgcaggacacggccacgaacgacgtttttctccagaacagacagaacgtcaagaacttctgatttttccagttcaacacctttttctactgcttctgcaacgataatcgcagaaacttcttctttgatggtattaacctgagcgtaacgttcttgtttttcggtaatacggtaagcatcacccagacggctttctgccagttcagcaacgcgatcatgcagtggctggttgatagattctggtgcccagtcccacttctctttacccgtttcagcaactaacgcattgatgtgatcaatcacaatctgctgctgttcgtgaccaaagacaacggcacccagcatctgctcttcagtcagcagctccgcttcagattcgaccatcaataccgcgcctgctgtacccgcaaccactaaatctaaacggctgtttttcagttcatcactggttgggttcaacacgtactgatcgttgatgtaaccgacgcgtgcagcaccaattgggccattgaatggaatgcctgacagtgccagtgcagcggatgcaccaatcatggcaacgatatcagggttcaccagtggattaacagaaacaactgttgcgatgatttgaacttcgttcagaaaaccttctgggaacagtgggcgcagaggacggtcaatcaaacgggcaacaagggtttcaccttcacctggacggccttcacggcgaaagaaacttcctggaatacgaccagcagcgtaagtacgctcctgatagttaacggtcagtgggaagaaatcctgacctgctttcatttttttctggccaacaacggtaacaaataccgcagtgtcatccatatttaccataacggctgctgtcgcctgacgagccatcatgcctgtttcaatggtcactgtatgctgaccatactggaatttacgaacaatcggattcagcaaaatcatattccttggttagtgttgccgactctaaatatcagcaacaatagacattctctttttgctacaccctcacgactaatgacaacacttaattcccttaagcactctcattagccgcgcgagtccctgtaacggaagaggttaaaatttcagaaacagaacttaagtttttaacgttccgcttcctagaagaaaaggggccctattaggccccttttcactgaaactcatcaattagcgacgcagtcccagacgctcgatcagtgcagtataacgtgcaagatctttgcgcttcaggtagttcagtagcttacgacgctgtgcaaccatgcgcagcagaccacgacggctgtggtgatcttttttgtgctctgaaaagtggccttgcaggtggttgatttgagcggtcagcagggcaacctgaacttcgctagaaccactgtcattagtgccacggccaaactcagcaacgatttgcgcttttgcttcagtgcttagagacatagtataactccaaatatagattaaaaatcatgagtgccgatctctaattcagcaactcacatatagacgcgctattctacgctgcaaataggggaagcgcaagacagcccagtgatcatcatttccacgttccagtacaatttgcctgtttcttatctgtaccaaattgcctgttttaaaccacacaatttatgcgattagtttttataattgttctatttctaccaccagacgacgcggagccaccaagccaccatcatcaatcaccgcgatgccgatgaatttgttttcatccccttcagtgactctcacccattcaccggatgttaaactgtgtttactgcgaactggctgcccctgcttaagataagcagcaacaactgatgccaactgaatgactggaaaatgtgcgaccgctgtatccattggcagtaacaatggatcgagcaattctcccgcatcaacttcttgttcttcagcctgtttttttaattcatgcaactgttccagtgtcaccattctatgagtaggataattggcaacctgcaaacggtgcagataaattacatgcgcaccacagcccaatagttcgcctaaatcatcaatgatagtacggatatacgttcccttggaacagtgtatttccagctctagctcatcaccttcccagcgaatgaactgcaattcgtaaacagtaatcggacgcgcttcccgctcaattgcaattccctgacgggcatattcatacagcggttttccctgatgtttcagcgcagaatacatggaaggaacctgcatggtatcaccacggaatgtatccaatgcggctgcaagctggggctgggtaatctgcacttcacgttcacaaatgacttttccatgtgaatccgaagtgtctgtgcgctgtcccaaacgggcaattacccgatagcgtttgtcagaatccagcaggaactgggaaaatttggtcgcttcaccaaggcaaattggcagcattccggtagccagtggatctagcgcacccgtatgacccgctttgctggcatcgaagatccgccttactttctgtaacgcatcattagaggaaatatcctgcggcttatccagcagcaatacgccgtgtatcgcacggcccctacgacgacgccccatcacttttcctcgttgtgatccgtagaaacacgacgctgctcatcgtttttcacgactttagtgacaaggtttgacatgcgcattccgtctaccagagagctgtcgtaagagaacgtcagttcagggataacacgcagacgcatggctttgcccagcaaggaacgaataaaaccagaagcttcattcaaggccttaatgcccacgttaaccatatccgaatcttgcccttcgaccaacacattcaaaaaagtcacaaatactttggcataagccagatcacgggaaacctcaacaccagagactgttgccataccgatacggggatctttaacttcgcgctgtaaaatgatggcaatttctttttgcatttcctgtgcaacgcgctgagttcggctgaattctcttgccattgttttatctcctgacattttggggggcataaagccccccaagaatggaatgaatctatgatggtattaaacgatggagcgtttgatttcaataatttcaaagacttcaatcatgtcaccaacacggacgtcattgtagttcttcacaccgataccacattccataccattacggacttcgttaacgtcatccttaaagcgacgcagggattccagctcaccttcgtagataaccacgttgtcacgcaggacgcggatagggttattacgcttgatggagccttctgtcaccatacagccagcgatagcaccaaacttcggtgatttaaagacatcacggacttctgcaagacccatgatctgctgtttgtattctggtgccagcataccgctcattgcctgtttgatttcatcaatcagactatagataacggagtagtaacgcagatcaacactttcgctttcaataatacgacgtgcagaagcatccgcacggacgttgaagcccagaatgattgcgttagacgctgcggcaagagtcgcatcagtttcagtgatcccgccgacaccagaaccgatgattttcactttcacttcatcagtagacagtttcagcagtgagtcgcagatcgcttcacatgtaccctgaacgtcggttttcagaacgatgttcagttcagataccttaccttcttccatgttggcaaacatgttttccagtttagatttctgctggcgagccagtttcacttcgcggaatttaccctgacggtacaaggctacttcacgagctttcttctcgtcacgtaccacagtcgcttcatcacccgctgacggtacgctggaaagacctagaatttcgactggaatggatggaccagcagacgtgacttcaagaccaagttcgtcacgcatcgcacggatacggccatattcaaagccacacaggacgatgtcgcccttattcagagtacctgattgaaccagaatggttgcaactgggccacggcctttatccaggaaggattcaatgaccacaccattagccataccagtacgaacagcattcagttcaagcagttcagcctgtagcagaatacattccagcaattcatcaataccgagacctgctttggcagaaacgctcatgaactggttttcaccaccccattcttcaggaatgataccgtattgtgtcagttcattcttgacgcgatctggatcagcatctggcttatcgattttgttcacagcaacaacaacaggtacgttagctgccttggcatgctggatggcttccacggtctgaggcatcacgccatcatccgcggcgacaaccagaacgacgatatccgtcgccttggcaccacgagcacgcatagaagtaaacgcagcatgtcctggggtatcaaggaaggtgatcatacctttttcagtttgtacatggtacgcaccgatatgctgggtaatgccacctgcttcgccagaagctactttagtagaacgaatgtagtccagcagtgaggttttaccgtggtcaacgtgacccatgatggtaacaacaggcgcacgtgactcagccagcgtttcacctgtgtcacgatcgctcatcagcgcttcttccagttcgttttcacgacgcaggataactttgtgccccatttcttcagcaactagctgtgcagtttcctgatcaataacttgattaatggtcgccatagcgcccatcttcatcatggtcttgataacttgggaacctttgaccgccatcttgttggccagttcagctacggtaatggtttcaccaatcacaacatcacggttaaccgcggcaactggcttggtgaagctttgctgtaaggtactcggtttgcgctgtttgcctttgttacggccaactgcacgtgcttcttcgcgatcagctttcgattcagaatgtttgttattcttcttctggcgtgtagctttgccaccacggctacgggtacggcgatcgccttcaactttagcgtcattttcgtcttccgcagcacgggcgtgttgggaagtggttacgtgataatcatcagtattttcgctgggttcagcggtttctgaccatttatctttattttcttctgccatgcgacgcgcttcttccgcgacacgtttcgcttccgcttcaactttgcggcgcacctcttcttcagctttgcgttttaaatttgctgcttcggcttcacggcgcgctttttcactttgcacggcaggctcagtctgaactgattttggtttgttttcggtatgttgcttagtcactttttctttttccgccgcctcacgctgagtcatgtcaaccccttcgcgtttagctttttcttctgcttcacgttgagcgctctttgctgcttcacgttttgcctgttcttcagcatcacgtttagcttgctcttccgcgaattttttcgcttcagtttcaagccgcgccttttcttctacctcgcgccgagcctgctcttccgcttcacgcttcgcctgttcttccgttggagattgttcaatcgcgtcacggttcacatatgtgcgttttttgcggacttcaatcgctaccgatttacttttgccaccggtgccaggaacgtttagtgtactgcgagtcttacgctgtagtgtcaatttacctggctggccgccagaaccgccttgttcgcggttcaagtgtgccagcaaagattctttttctctctgggaaacagagtcagttgcggttttctgaatgccagcatcagcgaattgctggatcaggcgttcaaccgatgtctggatctcttctgccagtaattttacggttacctctgtcattctgttccttcctgctacagtttatttatgcatcatcgccaaaccaacagatattacgggctgccataatgagttctcctgctttctcatcactcagtccttcgatatcagataagtcgtcgataccctgctcggcaagatcttccagagtacagatgccatgggcagccaggttaaacgccaaagtacgatccatgccagataaattcaataaatcttcggcaggttgctgatcaccaagactctctttctgagccagttccagcgtcgtcaaggccgcttttgcacgttcacgaagaacttcaacggtttcctcatcaaggccttctattgccagaagttcattaattggcacataagccagttcttctagcgtagagaaaccttcctcgaccaatacggtggcgaaatctacatcaatgtcgagatgcttggtaaatgtatcaatagaagcatgtgcttctgcctgatgttttgcttgcagctcttccgcagtcatgacattcagttcccacttgtcatcaccacgatgttttttcagcagttgtgccgccaggcggacgttttgaccattacggccaatcgcctgagcaagattgctgctttccacggcaacatccatcgtgcagttatcttcatcaactacgatagatgcaacatccgccggagccattgcattaatgacaaactgtgcagggttatcatcccacagcacaatgtcaattctttcaccgcccagttcactggaaacggcctgtactctcgcaccacgcatacctacgcaggcaccaactggatcgatacgtttgtcgttggtttttactgcgattttcgcgcgagagcctggatcacgggcggctgctttaatctcaatgatctcttcgccaatctcaggcacctcaatgcggaacagctcaaccaacatctcaggacgagagcgggtgataaaaagctgtgcgccacgagcttctggacgaacatcatacaggacaccacgcacacggtcacctggacggaagttttcccgtggcaacatatcttcacgtaaaatgaccgcttcagcgttattacccaaatcaagggtaatattttcacggttcactttcttgacctgagcagtcacgatctcgccctgctgctcacggaactgatcaaccaccatcgcccgttcagcttcacgcactttctgtacgataacctgttttgcggtctgggtagtgatacggtcaaaagttactgattcaatttgatcttcaatataaccacccagttccatttctgggtcttcatattttgcagcttccagcgtgatttcacgggttggcagagttacttcctcaaccgccacccaacgacggaaggtatcgaaatcaccggatttacgatcgatgcagacacgaacgtcaatttcctgctcatactttttcttggtggctgtcgccagtgcaatttctaatgcttcgaagattttttcgcgagggagagatttttcattagaaaccgcttccacaacagccagaatttctttattcatcctagttgcctcatccgaactttaaaagtggggtaccaggttcgctttctggatgttgctcagtgcgaacacttcgtcttttccatccaccgtaaccgtaatcatttcaccatcgacaactttaataataccttgccatctacggcgattctgcattgccatacgtaaaaccagactaacttcttcacccataaaacgctggtaatgttcagccttaaacagtggacgttcaagtcctggtgaagatatttccaggttataaagcactgagatcggatcttcgacatcgagtactgcactgacctggtggctcacatcagcacaattatcaacagtgataccctcctcactatcgatatagacccgcagtgttgatacacgtgcacggataaactccaggcccactaattcaaaccccaaagcttcaactggtgctgaaatcatcgctgttaatttttgctctaatgtggacaagcccacccccaagacataaaaaaagggctatattagcccagtagttctgctgtcaaataacaaaaaaccccgatactcggggctttatgtaactggaccctgtttactgccagtggtctcaaccaacttcttttatacctatcaaaacaacctttcaaatcaggatcgatgtctctatggctgctgaattataactcttgaaaaggtatatgttgttaagaagtggttgcgggagccggatttgaaccgacgaccttcgggttatgagcccgacgagctaccatgctgctccatcccgcgttcgaaaacgtggcaaatcttacgctgataatactaaaaacgcaagtttctagattatggtgccgaggacgggacttgaacccgtacgcccgttgtttaggcactaccacctcaaggtagcgtgtataccaatttcaccacctcggcactgattatagaactgttatttcaacctgtcgcttatacttactgcttaaactaataacctggttaaactaacaactccattttaattcttttactgaaaattactgtgggatatcactatttggttttgctggcgatgctggtacttctgcttgtttttcaacttttacaggctcagcaagattttcccacttactgtctgaaccagttcggttgctgctcatgttacccagaatcaaactgataacaaaaaacaatgtagcaaaaatagccgtcatacgggtcataaaattactagatcccgatgaaccaaacagtgttgcagacgcacccgcaccgaaagaagcacccatatcagcacctttaccctgctgtagcagaaccagagcaattactccaagaccagccagcaagaatacacctaaaagagcttcatacatatgtcgtacctgtttcctcgtggggatttaccacaattctgtagcaacgttatactgcatcacccgctcataattagaaaaattaacttattgagcgggtgtgaatactaaccaaagcgtttcagacaagcaaggttaatttcaaatactggcgttgttcgaagaaaaaatcaacaaattaccctgtttttttcacggcatcagcaatacggtgtgccaatgcagtgaccaattcttcatcttcaccttccaccatcacacggataagtggctctgtgcccgatttacgtagcagtactcgaccacggccgttcaattcagcctcaaccgatttaacggcttctagcacagattctgattgcagaggatcgttgtcacctgcaaaacggacatttaccaaaatttgtggcagaagtttcatgccgctgcaaaggtcatgcaggctcatattattccgtaccatcgcgctcagtatctgcaatcctgccacaatgccatcgccagtcgtagttttatccagcaaaatcacatgaccggaattttccgcccctagacgccaacctttttcttgcaatttttccagtacgtagcgatcgcccacttttgctcgctcaaatgggatgccaagctgtttaagagccaattccagccctatattgctcattagagtaccaaccgcaccaccgcgcagttgcccctgtctcaatgcctcacgtgcaatgatatagaggatctggtctccatccactttctgtcccagatgatcaaccatgataatgcgatcaccatcaccatcaaatgccagaccaacatcagcctgttcttcctgtacccgcttctgtaacaagcgaacatctgttgcaccacactcttcattaatgttgatgccattcggctcacagccaatggtcacaacattcgcacccagctctctgagaacgttcggggcaatatgataggttgcaccattggcacaatctaatacaactttcaatccattcaggctttgttcactcgggaatgtgcctttacaaaattcaatataacgaccagccgcatcaacaatccgattggcacgccccaactcagcagattctacgcaggtcagtggtttttccatttcagcttcaatggcttcttcaacattatcaggcagtttggttccatcgatagagaagaatttaataccgttgtcatagtaaggattgtgagaggctgaaatgacaattcccgcttctgcgcggaaagtacgtgtcaaataggccacagctggtgttggcatggggccagtaaaagatgctgatagacccgctgctgccaaccctgcttctagagcagactccagcatatagccggaaatacgcgtatctttaccaatgataatcttgcgagaaccatgacgcgccagtacttttcccgcagcccaaccgagtttcaaaacaaaatcaggggtaattgggctatcacccactttgccacgaataccatcagtaccaaaatatttacggctactcataaattttttcttcctttgctgaacgtgttctttgctcacagcgtgttcttgacagccagtatgtttttcgctgacagtgttgcctgaacaatttgcattgtctgtacggtttcttttacatcatgcacacgaataatctgggcaccttgcatcgctgcaatcacagcgcaggcgatacttcctgttacacactcctgcggtggtacatgaagtaattggccaatcattgatttgcgtgacattccagccagaataggcaagccaagatgatggaattcttccaaatgagccaatagctgataattatgcgataagttcttcccgaagccgaagcctggatcaaggatcagtttgttttttgcgatgcctgccgcaacacagcgatcaatttgcctcgtcaaaaatgttttggtttcccaaacggcatcttcatagtatggctctgcctgcatagtgctgggttgtccctgcatgtgcatcaggcaaacaggcaatcccgtctttactgctgcgtcaagtgcaccaaactcctgcaacgaacgaatatcattgatcatatgagccccgactttagcagattcctgcatcactatggcttttgaggtatcgatggagatccatgcatcaaaacgccgcgccagtgcttcaaccacggggacaacgcgatccagttcttcctgctcactcacatccacggcaccagggcgtgtcgattctccacccacatcaataatggctgcaccttcctcgatcattgtggctgcgtgccgcaacgcggcatcaaaggtactgtgattgcctccatctgaaaaagaatcaggagtaacgttcagaatccccattacttgtggacgggaaagatcgaggacactgcctctggctgtcagtttcatcgctagggtgccttaatgtcaaaaccccagaaagatctggggtttaataagtacagtctgtcaaatccaagggcaacagtctgtaattgcccttaatttgataaaggttgttaactgtattatgcggttggattaccatccgcaggtttcacagtctgctgcggagatgacatattatgacggttattaccgccattattgttgtcaccttcccaacctgctggtgaacgcactgttgttcgattcatcaagtcatcaatctgagatacatcaatggtttcatacttcatcaacgcatctttcatcgaatgcaggatatccagattatccatcagaattttacgggcgcgttgatagttacgatcgacgatagctttcacttcctgatcaattaaacgcgcagtatcttccgacatgtgttttgctttagcaaccgaacggccaaggaagatttcgccttcttcttccgcatacagcagtgggcccagtttttccgaaaagccccactgtgtcaccatgttacgggcaatggatgtcgccaccttaatatcgttggatgcgccagtagaaacactgtctacaccgtagataatttcttctgccagacggccaccgtataatgttgaaagctggctttccagtttctggcggctcgcgctgatctgatcaccttctggcaggaagaaagtcacacccaatgcacgaccgcgaggaataatcgtgactttatgaacaggatcatgttctggcactagacggccaatgatggcgtgtcctgcttcatgataagccgtggattctttctgctcttccgtcatgaccatggaacggcgttctgcacccatcatgatcttatcttttgctttttcaaactccaccatggaaacaacgcgcttattgccacgagcggcaaacaaggcagcttcgttcgcaaggttcgcaagatctgcaccagagaaacctggtgtaccacgagcaatgatggaagcgtcaacgtcggtatccagcgggatacggcgcatatgcactttcaaaatctgctcacgaccgcgaacatctggcaggccaacaacgacttggcggtcgaagcgacccggacgcagcaatgcagggtccagcacatcaggacggttagttgcggcaataacgatgatgccttcattaccttcgaaaccatccatttcaaccagcatctggttcagtgtctgttcacgttcatcgtgtccaccacccagaccagcaccacgttgacggcctacagcatcaatttcgtcgatgaagatgatacaaggcgcagattttttcgcctgttcaaacatatcacgaacacgggaagctcccacaccaacgaacatttcaacgaagtcagaaccggaaatggtaaagaaaggcactttagcctcacctgcgatggcttttgccagcaacgttttacctgtaccaggaggaccaaccattaagatacctttcgggatcttaccacccagtttctggaaacggccaggttcacgcagatattccaccagttctcccacttcttcttttgcttcgtcgcagccagcaacatccgcaaacgtggttttaatctgatcttctgtcaacatgcgggctttgctcttaccaaaagacatcgcccctttaccgccaccaccttgcatttggcgcataaagaatatccagacgccaatcagcaatagcattgggaaccaggaaataaagagagtcgcgagcaggccctgttgttctggtggttcaccaataactttcacctgcttattcagtagagtatccagcagcttctcatcctgaattggcatgtaagtgctgtattttttaccgtcgtctttcttactgtaatcaatatcacgacccgatatacgtacttctcgcacttgattctgagataactcactgatgaaattagagtaatctaccctacgaccgctagagtcgccaggaccaaaactctggaacaataccatcaagacaactgcgatgactaaccagagaatcaggtttttcgccatgtcactcaagggattaacctcatattacaactgtgttaacaaatagtagtcagggtactacagtttccgccctgtcgctacaatgtatacttcacgcgatcgtgcccgcgaagcttctggtttacgaattttaaccttcgtaaaaagggagcgtatttccctcaggtattcatcaaagccttctccctgaaacactttaacgataaaactgccgccaggggccagcacatcacgacacatacctaacgctaactcaatcagatacatggatcgaggaatatcgaccgcgggggttccactcatattgggagccatatccgacatgacaacctggactttattatcacccactctctcaagcaatgctttcaatacaagttcatcacgaaaatcgccttgaaggaaatcaactccaacaatcggatccattggtaaaaggtcgcaagcaatcacccgcccacgatcaccaatctgattgactacatattgagaccaccctcccggagaagcgcctaaatcaacaacggtcatacccggtttaaagattttgtcgctttgttgtatcccatcaagtttaaaccaagcgcgagagcgaagcccttttttctgcgcctgaagaacatatttatcactaaaatgttcctgtaaccagcgactagagcttgctgagcgttttttattggccattgttctttccaactatacgaatagagagctatatttttgcactctcctatcaaatcacgccatacttttatggtgatagatacgagatggcggtagaataggccgttttcaatcccaacataagcaaaaaaacgatgactcttaacaagaaacaagtgcaatacctgaaaagtctcgctcattcattaaagcctgtcgttatgattggtaacaacgggctgactgaaggcgtgttggctgaaatcgagcaaactctttcgcatcacgagcttatcaaagtcaaagttgcaggcgaagaccgtgaaatcaaaactttgatcgctgaagcgattgttcgtgaaactggtgcatataatgtgcaaatcattgggaaaatgctagttctctaccgtccatcgaaagaacgcaggattagtttaccgaaataatcacagcatatttatacaaaagtgccatatctaccatgataaaaaaggccatctcaggccttttttatttccatatcagcataatggccgcttgccacgatttctctgtaacagtttctcaccctcacaggcaggattaaactgtttcccaacatcagagatactcgacattcagaacttcatattccactttgccgcctggcgtactgatcacagcaacatcatccacttctttaccaatcagcccacgagcaataggtgaattcaccgaaatcaggttctctttgatattcgcttcatcgtcacccacgatacggtaagtctgttcttcatcagaacccatattcaataccgttaccgttgccccaaagatcacacgaccattattaatcatcttcgtgatatcaatcacctgcgcattggaaagtttagcttcgatttcctgaatacggccttcgcagaacccttgctgctcacgagcagcatgatattccgcattttctttcaaatcaccatgcgcacgcgcatcagcgattgcggtaataattttagggcgacgtacatttttcagattttctaattcttcgcgcaatttatccgcgccacgtaccgtcatcggaatttgtttcatttatcaaacctctaaatcaatcctaagaccaaacaacatcttcctgatttttgcaataacagcataatgagcacaccttatcaggcgagtctccagacaataaaaagagagcaaactacagtataccctgaagttcacatatctattttgcctgctaatctattattctaacgtagagttgataatggatcatcgtttactttttcctgaatttcaccttagtattattgatgtaaatatttttagaatactttcaccttcatatgcgagatctatggctcttttaaagattaccagcagaatagcttgtatgctcagttttagtctgagcattttcagtgcaaatgcttcctcaatagaagaagatgctcaatatttgcctgcgggaactgacttctcatttattgcccagaaaattggctcaaaaacgcccttacttgattataatgggcagcaattggcattacctgccagtacgcagaaaattgtgacggcattggcagccctgttacagcttggcaaggattaccgttttatcaccacactggaaagtaatgctgatatttcagatgggatattgagaggcaacctaactgcccgttttgttggtgatccaacgctgacacgttcgcaactgcgcaatatggtagaaacgttgaaacaatccggcataaaacagattgatggcgacctcatcatagacagttcaattttctcaagccatgataaagctccgggttgggtgtggaatgacatgacccaatgcttcagtgcacctccagccgccgcaattgtcgataaaaactgcttttctgtttcgctgtacagttcagaacaacccggtgaactggcgtttgtccgtgttccttctttttatcctgtcaatatattcagtgaagtaaaaacgctgtctaaaggctctccagaagcaaaatactgtgaactggatgttacttcaggtgaattaaacagatttactctgacaggctgtctgacacaacgcagtgagccactaccactggcattcgccatccagaatggagctagttatgcaggtgccattttgaaaaatgaactacatatcgctggcattgagctaaaaggtcacctacgtcgccaatcagatcctgagcaaccagagaagattctcgctttgaatgaatctgctccattgcatgttctgctcaaaaccatgctgaaaaaatcagataacatgattgccgataccctctttcgcaccctcggccatcgctatttcaacgtgcccggaacatggcggactggttctgatgccattcgtcacatactgaaacaaaaagcaggcatcgatctaggcagtaccatcatggttgatggttccggcctttcacgccacaatttaatcacaccagcaaccatgatggagatcttgcaatttatcgcgcaacataatgatgatctcgactttatctccatgctaccaaaatcaggttatgacggtactctgtcctatcgtccgggactccatgaagcgggtgtaaatggtaaagtctttgcaaaaacagggtcactgcaaggggtttataatcttgcaggctttattaccgctgccagcgggcagaagattgcttttgtccaatttatctcttcttattctgttttacctgacgatcaacgtacccgccgtattcctttggctcgtttcgaaagccatttatataaatcgttataccaaaatcattgatcgaaaaagggcgcttaaaaagcgcccttttatcattcttatacatcaggaacgaagatctagtgtttataaataaactctatgccttcttcgtctccctcatcccagtcatcatccaaatcatcgtcaacatccgcatcagatgattgttgtaactgttccttatggtaatcatcccacatgaattcaactttttccggctgggcttctgcctccacgtccatatggcgaggctgagctttcatgaattccatgatgtcccagcaaagctctttcacaccctgacgatttacagctgaaatcatgtaataatcaccttcccagccaagctcatcagcaatggcttttgcccgctgtttagcttcttccggatcggtcagatcgactttattgaataccagccaacgcggtttttctgccagtttttcgctgtatttatgcagttctttgataatgatacgggcattttcaaccggatcagattcatcgagcgggcagagatcaattaagtgaagtaagacacgacaacgttccaaatgtttcaggaaacgaatacccaaacccacaccttctgacgcaccctcgatcaaaccgggaatatctgccactacaaagctttgctcgttatccatccgcacgacgccaagacttggcaccagtgtcgtgaatgggtaatccgccactttaggtttcgccgccgaaacagagcgaatgaaggtggatttacctgcattaggcatccccagcattcccacgtctgccagcagcatcagctccagcatcagctcacggctttcacctggcgtccccatagttttttggcggggagcacggttaacagaagatttaaagcgggtattaccaagaccgtggaacccccctttagcaaccatctgacgctgctcatgacgcaccatatccgcaaggacttccccagtcgcgatatcgcgcacacgggttcctactgggactttgatggtaatgtcttggccacgtctaccggtacaaccacggctttgtccgttttgaccacgttcagcacggaaggatttttcaaagcggtagtcaatcagcgtattgagattttcatctgccagcagataaacatcaccgccgtcaccaccatcaccgccgtctggcccaccttttggaatatatttttctcgacggaagctgacacaaccattgccaccatctcccgctacaaccagtatgctggcttcatctacaaatttcatcacttttctccgtaggataaccaccgtaaagctggatggctgctgtacccagagatggcataattcagaatataaaaagccccgcaacacacattgcagggcttccgattcgattgagactcaaaaaatttattcagctacgatactgataaacttacggttttttgaacctttaacttcgaatttaatttttccgtcagctaatgcgaacagggtgtggtcacgaccacaacctacgttgctgcctgcatggaatttagtaccacgttgacgaacaatgatgctgcctgccaaaacagactcaccaccaaaacgttttacacccagacgtttgctttcagaatcgcgaccgttacgagtcgagccgccagcctttttgtgtgccattaatctgctctcctaaaatcttaagcgatgccagtgattttaacatcagtgaaccactgacggtggccctgctgcttacggctgtgtttacgacgacgaaacttaacgattttaattttctcgccacggccatgagcaacaacttcagctttaactttaacgccttcaactactggagcgccgatcttaatatcttcaccattagcgaccatcagaacctggtcaaactcaacagtttcaccggttgcgatgtccagcttttccaagcgaattgtctgaccttcgcttactcggtgttgtttaccaccactttggaaaactgcgtacatataaactccgctttccgcgcacccccttaaatatctttccagagcgcgctataaaatattcacaatagggcgcgaattctacgcaaaaaccgattcgaagacaagtgcagaattagaacagatgagaaaaaaacagagtttttcgattgtcatttatttgaacggtttttcaagtacaatcgatacatcgtgatatctgttgatatgctaatttaatgagcacagctctgaatcagagtccaaagccaaaacatgaatttagaatcaataattaaacttaccgctgatgatatggcagcggttaatgaaaccattcttaatcaattaaattctgatgttgcgctgatcaaccaacttggctactacattatcagcggcggtggtaagcgtattcgcccaatgattgcggtactggccggaaaagcacttcattgtgaaaaagaaaaacatatcaaagttgccgccttaatcgaatttattcacactgcaacgctattgcatgacgatgttgtcgatgaatccgacatgcgccgaggcaaagcgacagccaacgctatgtatggcaatgcggccagtgttctggttggtgatttcatctacacccgatcgtttcagatgatgactgatctcgattctatgcgggtactgaaattgatgtccgacgccacgaatgtcattgccgaaggtgaggtgatgcagttgatgaactgcaatgatcctgatacctcagaagatgattatatgcgtgtgatttacagtaaaaccgctcgcctgtttgaggtagcggcacactctgcggccattttatccggtgcgacaccagagcaggaagctgcactgcgtgactatggccgttatcttggcacggcgtttcaattgattgatgatctgctggattacgattcagatgacagcacactcggtaaaaacacaggggacgacttaaacgaaggcaaacctacactgccccttctgcatgccatgcatcatggagtcccggagcagtctgcactgatacgcagtgccattgagcaaggcaatggccgccatttgttagataccgtactagcaacaatgaaacagtgtggttcacttaagtacacccgccaacgggcggaagaagaagcagataaagccatttcagcgttacaagtactggatgagtctccatataaggcggcccttgtgggattagcccatgtcgcggtacagcgactttcctgatctgagctaatcagtatcccagattgctcaatctgggatactgtctttattttcaacctcttgaattcctatgtattggactaggctagccagccctttcctcaaaatgaacttaaccatgcgttccctttcgggtttggttaattgataataagcttcaatccaaatcatgaacggatcctgacgcttattccgataatactcgaccgaactttcactgacggccagtacattcagaacttcttcgggcaagctgttgacatgatattcgagagctttcccctgtactccgcgcttacggcgttgctcccaaccttcgcgccttgccatcaaattgacgccttggggagacgatggcagacctgcgaggccaatgagttcttttgcagaataccaatcttttttcatctttttatcctcgctttacatcggagcagtgtagaggaagccaaattttaaacatttggcttttcaaaagctgcctcaagtagctatgattttttccaaaaaacttcttatgccatctcgtaatatcacttctgtaatcgcctccttttcttcatcggagagtaaattaaatgcactcacccaaatggatagaggatcttgtttctgaacctgatattcaggtgatatttcatgaagctccagagccgacaatgttgattcaggaaaacaagaatagtgatattcaatagccctgccttgaacacctgctcgtttctgtctcaaccattcttcacgttttgctctggcattaactccttgtggtgatctaggtaactcacctacaccggtcaactccattgccgtataccactcttttttcataatgtttctctatttttgtaaccaagttcaaaaaagaagttattaagaaaaaattagaaatatttttaggaaaaataatgttattttattttcttaataacagattcgtgttcgttattaatttcacactaacgctttagttataccactaatgtggcttcaaatttaataggaaaggattaaaaaaatgatttctatgaaatcggattggcatcctgctgatattattgctgctttacgtaaacgcggaacgacactggctgccgtttcacgcgaagcagggttaagctcatcaactttggcgaatacactttctcgcccatggcctaagggagaatggataatagcgaattacttaggattacatccggctgaaatatggcctagtcgttatttcgatccacatacaggagaactattagaaaggaaaattagagaaaaaaagaataattagctatcaatataattattgaaagaaaaaccgctagttatttttgagctagcggtttcagttatctaatatatttaacttaattcgtatattaataaattacaaattaaatgaattaaccgttaataaatttctcgcctaattcgatatcttttttgagaacgcccaacatactatccagtgacttctgttcaaaatcgctaagtttgccgatatctaaacgttcttcgataccatttttacctaaacgaacaggctgagcgaagaaacgggcatatttaccatcaccttctacataactgcactcgatgacattgctttcaccctgcaagccacggatcaaagaaagacccagacgtgccgctgcctgccccatagacagagttgcagatccgccacctgctttcgcttcaaccacttcagtacctgcgttctgaatacgtttggttaacgcttcaacttcttcatcagtgaagctgacgccctgaatttgcgacagcaatggcaggatagtcacaccagagtgcccaccaataacaggcacttccaattcctcagagttcttacctttcagttctgcaacaaaagtattggaacgaatgatatccagcgttgtaataccgaacagacggtttctgtcgtaaacaccttcttttttcagaacctcagccgctatcgccacagtagtattcacagggttcgtgataataccgattaatgcttttggacaagccttagctacctgctgaaccagattacggatgatacccgcattgatattgaacagatctgaacgatccatgcctggtttacgcgccacacctgcagagattaatacaacatctgcgcctaccaatgcaggggttgcatcttcaccagcaaaaccagtgactttcacttccgttgggatatgactaagatcggctgccacacctggagtcaccggagcaatgtcatacaaggaaagttctgaacctgaaggaagctgggtcttgagtagaagggcaagtgcctgaccaataccaccggctgcaccgagaactgcaactttcatcctgatactccttaaataagtgctgtaaaaaacttaaacctgtctggttaagagcctgaacctatttccctacattcaatgcatgtatgggatagattctcagccccactgatcactacgtattaagaacaatctgttaacagacagattatctacctaatggcttgatgatgaaacaccaaagttattttattctagacaaaaggcttatctgttaatgagataacggacacttttttgagaattaatcctgttatattattaataacttagttgattaccttactcttatctcccaaaccaaacaacaccatttaattaacaatatatttaccatactcaaaatgtgggaaaggaaacgcagagaaaatgtacacatgagtattactgacgactaataaagatatattgggagaatgaaaataatgtaattatgattattattttagttttttcttctcttccttgaataaaaattcactctttcgcataatcatagcttcataacggattcaatgatggtgaaatatgcgtgttccttcgaaacaggaagatttggtcaaggctttcaaagccttattgaaagaagaaaaattcagctctcaaggtgaaatagtcgcagcacttcaggaagaaggctttgaaaacattaaccaatctaaagtttccagaatgctgactaaatttggcgcagtccgaacccgtaatgcaaaaatggagatggtctactgcttacccgcagaattaggtgttcccacagccacaagcccattgaaaaatctggtcttagatgtcgattataatcattgtgttgtggttattcgcaccagtccgggcgctgcacagttgattgcacgcttactggattccctgggtaaagcagaaggaatacttggcagtattgcaggggatgacactatttttacgacaccagcacaggactttacaacaaagcagctctatgaggctattctcgatctttttgatcaagaactttaaccctgtcgtataacccaatagatttcaagttgcagcacggcggcagacaaacggaaccctgggaatatatagattaaagaggatcgcacagctaatgcgatccccccactctgacgattttgacaatcaagcctcgtgcactttcttacccagctcagtcagcaacttctcgtgaatgccatcgaatccaccattactcatgataagaatgtaatcacccggttgtgccgcctcaacaatcatacgtaccaaagcatcaatatctgcactccaacgagcaggttggatgcagtgttctgcaatttctgctacctgccacggaatattggcaggttgatacaagaagacttcatcagcacgccccagagaaggcgcaatatcatttttgctcatgcccattttcatggtatttgaacgcggttctagcacagcaagaatacgagcgacaccgccaactttacttctcagcgctgccagtgtcaccaaaattgcagtgggatgatgagcaaaatcgtcataaactgagataccattcacttcaccacgcaattcaagacggcggcgcgcattgataaaatcgcccagtacctgacaagcatccgcaggctgaacaccaacatgatgggcagccgcaattgcgatcaaaccattgtgcatgttgtgttcacccaccaatgaccagttcacttcaccaacctgttcactttgatggaacacttggtagatgctgctatcctgactgactttcttcgtttgccagttacctgtttccccgacatgttccagctcactccagcatcccattcctatcacatgtttcaggttaatgtcattatcgggtaccagaatcttaccacttcccggcacaaccctgacgagatggtggaactgcttttggacggccgctaaattttcaaaaatatcagcatgatcaaattcaaggttattcatgattagcgtgcgggggccgtaatgcacaaattttgaacgcttatcaaaaaacgcgcagtcatactcatccgcttcaatcacgaaaaatggactttcaccgatttgtgctgaaacgtcaaaattacccggcacaccgccgatcaggaaccccggcttataaccgcaggcttctaagatccatgctaacattcctgcggttgtcgttttaccatgcgttccagcgacggctaacacccagcgttctggcaaaacatgatcatgtagccactgtgggccagatgtataaggaatgccacgatccagcaccgcttccacacagggattaccacgtgtcatggcattgccaatgattaccatatctggctcaggatcgagctgtgaaggatcatatccttgaatcagctcaatgccctgtttttccagaagggtactcattgggggatacacattggcatcagaaccagtaacttcatgacctaatgaacgagcgaggatcgctagccctcccatgaaagtaccgcagatgccaagaatatgaatacgcatttatttctatccaatatcatgaagtgtgtcactattctaaccatcaatgctgagattagaaatgcaatagcctatcaatcatcccattctttagctaaactgccgcgcatgagtgcgacacgcaagtgcagcacgctctctaaaaccacaacaaaattcagggctttcgtcatgaaaacattaggcgaattcatcgtcgagaaacagcaagactttcctcatgctacgggtgaactgaccgcactgctttctgccatcaaactgggtgccaaaatcattcatcgggacatcaataaagctggtctggtggatattttaggtaccagcggcgtatcgaatgttcagggcgaagttcagatgaagctggatttgtatgccaatgaaaaactgaaggctgcattgaaagcgcgcggtgaagtagcaggtattgcttctgaagaagaagatgagatcgttgtctttgatggcgaccgtgcagaaaatgcgaagtatgttgttttgatggacccactggatggttcttcgaatattgatgtaaacgtttccgtcgggactattttctcaatttaccatagaattacacctattgggcagccagttaccgaagacgatttcctgcaaccgggaaatcgtcaggttgcggcgggttatgtggtctatggctcatccactatgttggtttacaccacaggttacggagttcatacattcacttacgatccctcactcggcgtattctgcctgactcatgaaaaagttcaattccctgccaaaggcaatatgtactccatcaacgaaggaaactacatcaaattcccgatgggcgtgaaaaagtacatcaaatattgccaagagcaagacgaagccacccagcgcccttacaccacccgttatattggctcgctggttgcagatttccaccgcaacctgctgaaaggcggcatctatatttatccaagcaccgcaagtaatccaacaggaaaattgcgtctgctgtatgaatgcaacccgattgcttttttggctgagcaggctggcggcaaggccagtgatggcaaaaaccgaattctagatatcacaccaacccaactgcatcagcgtgttcctttcttcgtgggaacaaaatcaatggtggaaaaagccgaaagctttatggctgaatttccaggtgagtaagtaggtttgttgattgaatagttaatttaatgaaggggcgaagtgtcgcctctttattaacaacgcgacttatcctttaatttgttgagcaacacgcttaacgcaacgacttgctctcaacgttaacgtcactttttcctgccgattatctatattgttcccttaagttctatacatactctttttctatttatatttgttcacgaaatcattctgttcatgactcatgaaccagacagaaatgtgaacaataaaaaagtaaataatcactttttatccaatacaacagattttataacacccaattactgagctgtatggcgttcaacgactggaaaaatgcggggactttaagtctgttttggctataatagcccgcactccattttggtttgaaattaaaggaaaccttttatgagcctgaacaatgtaccggccggtaaagaactgcctgaagatatctatgtcatcattgagatccctgcgaatgcagatccgatcaaatatgaagtagataaagaatctggcgcactgtttgtagaccgtttcatgtctactgcaatgttctatccttgcaactacggttacatcaacaatactctgtcccttgatggtgaccctgttgacgtgctggttcctaccccatacccattacagccaggttccgttattcgctgccgtcccgttggtgttctgaaaatgtccgacgaatccggtgaagatgcgaaattggtcgctgttcctcacaccaaactgagcaaagaatacgatcacatcaaagatgtgaacgatctgccagaactgctgcgtgcccaaatcacccatttctttgaacattataaagatctggaaaaaggcaaatgggtgaaagttgacggttgggacaatgtcgaagccgctaaagctgaaatcctgtcttctttcgaacgcgctgctaaaaaataatcctgagggataacagcgagttttggtcataaaaaacctctgccaccacatagaggcagaggtttttatttattcttcttcgtggcgcttgatccagtcaccacatgttatccgatgcagtccatcaacaggcagtctatataaatagatccatgcactgccgtaaggtgttttaatcaattccctttcgtattcctgataattctttttcaaagcatccagttctgtcaggatggatggcgtaatgcgatatacttcgcattcaattgtcccttcgccacggatcaccgctggataatgtcccaggtcataaatttcataaccttctaacctatgttctcctagaagttgggcataggtcatccagtggtggttaccttgtttgcgcctcaggctgccataaacaattactcgcatttttaaaactcaaactcatagagcagatctaaagcctgatcaataccagataccgcatcgagatacaatcttggcattacacgatagcgtaatgtcaaggtcgccagagaatcaaaaataccaacaccgtatttcacctgcaagttgttggttatcttgccgctgacgacaacctgagatttgtcacccacaccctgagtatctaaagctaaatcagaaacaccaaaagtttcaccaatcttgccaaccaattgaccactttgggaaacgcccaaaccaattagcatggaagtcatttggttattgtcagaaccactcttctccaaaccttcaccacgcagaagataagacagtgcttcctgctgtgattttgctggctcagagaaaatttcaactttgggtttatccgccaatcccgtaactttcacaccagcgacaaccttattcgccgtcgagtcggggttacggatcgcttcaatgttcagcattggctgttccggcgggccggaaaatataattgtgcccttgcgtaccagcaaatcctgcccgtaggcatggaaacgaccatctggaatatcaatttgaccattcaaccccagcccctgtttatcctgaatgactttcaagacccccttaagttgagctttcagaccaaatgcattcaaacggacatcatcaccaatgcgaatatttaagttacttttaaccagaatggacgattttttcttttctatcggctggagatttttatctagcatgacttcgtcagaagaaatacccacagcagactctggtaattcctgcaccgtaatgcgtgcccacggaatatccacattcccatcaagtttcagtaaatcaggcgtagcttcaagtaccaaattagggctaacatcaattttcaccattggcggcactgtcacacgcaatttttcaccattcgcggcaattttggcataccatgcgttcaaattacgccagtcagcattgccgttaaggttcagctgccctttaggcgttttgataacaccctccaagccagagcggacaccatcaaaatagatagctagctggccttgagtgatatcaaaaggtaaccagtgacttacgatttgaaggtcatccgtcttaagctgaccaaacaacagcggattttttacattaccaccgaaacgcaggttggcattcaagcctccttccgctttttcgtctttacccaagatcggtttaatcagctttaaagaaagagctcgaatatccacattcccagatagcttgcggcggccttccagatcatccacctgaacattgccatttaattgcccattgcctgccagcttaaatagccatgccacatttgccttaccatttgttagtcctgcattcactgttaacgtttcaaaatcaacaggtaatgcagctccctcaaccatttggtgaagctgaaccccatttccttgcaagacgactttagcctgtggcaaagcctgtcccgccgtccatttgacattggcattcccgctgaacacgcctttaacttgagtcattttatcaaggaatggctgaatcatggccaaatcaaaacgtttaagcaccacttcagcatggccactggctcccgcctcaatcggtttgggaacacagatctgtgcattcgggttaagccagcaatgtgttcctattgttactttctgctgtggattcaggtaatcaatgaccatcgccttatttaggcgccactcaccgacaggagtatcaaagtaggtattgttgatagttccttgccagcgttcctgactgcggtcaaagcgaccactgagtgccaattgacctgatacggggttgccctcaatgttcaaatgtaaatcatgctgcttttccgtgcccttagcatttagcatcaaattattgatgattaaatccgcctgtttcaattgatgaacagcaactgagagctgtccttcaatctgttcagccgagcgcacatctcccttaatcgtggcgctatccactttcagatcattctgccaccgcacattacgtgcatttaaatctgccactatttgtggtgctttcatgttaccgcgcagtttcacattaccgataaccacaccggacaatcctggcagtaatccatttaactgtggcgcattaatttcaccatccaacttccacttttcatctgtaagctgcccttgaacattcagcctattacggccaaaagtgaggtcaaactgaggaatattccattgtcccgccgcattgccagacgccttgccatgtgctttgacgatattctgtttcacataaccatcaagagcaatttcagggatctggagttgccaactgccgccatacaagctaccgcgtattgccattttgccattcattttggctggccactctggccattgtttagcggtattgatgccatccagaatcaggttcgcattccagctaatcgctttgctccagtcaacgatgccagtgatctccgctttcccctgcaatgcagacagacgcagacgggttagcctgagcaattcttcattacccttcgcatccaacattagtaatgcaggaggaatatcacgacctttaatatctgaacggagggagagatcgtagccactggctttgccattcagtcgaagcttaacaccatcaagtcgatattccggttcacccgtcaatggccactgaagttgtttgctttccaatgtcaggcgtacaggcaaacccgccttcgccaactcagtctgagcactcagattggcaataataggtcctgaaagatgcaatgccagattaagctgctgcaacagagcaccattcagggttaaatcaagcttttgtccttttagttcattcagattcgtattgctcttaatcaccagtttgactggccactgttcagatagccccgccgtcccctgtagcgaaagtgagccttccggtgcacttacactgaaggttttcacatcaacctgctgtccctgattactggcttgcaaccgtagatcattaatcgtgatatctgtatcacctgtcaggcgaagctgactgccatgaatgttttctgccataatatcgagaggaataggaacattgggcaattcagctaagaaaggtttggcaaatagcgctttcaaggtttcacccaatgatttttcaggttcaggcttttgtttgcccttttgcactgtaccgctttgttcaggccgcgttttaggcagagcaaccaatagattgctgattttcgttggtttcaatgtcagctgtttttcccgccactgcgcccctgttttaaattcatccaacgcaatcactatatcgtcaaccttgacgtggatattcttcaaagaaagcaaatccagtgaaataggatacggtgttttcaattcagtcaatggctctgatgcaggcgacttttctgatggaggaagatcagccgtattcaccgagactgccacgccttccgtagttaacgcattgacacacaggtgactgtgtttcaagcaggataaacgtagcgaaaggtataaattgtcagcactaacactcactcccggcatctgatatttaacaccttttaaggttaaatcacgccatcctccgctgacattggcgatatccagtccgggaacccaacgtgctgcgctgttaatcataaaatgcagtccggtttgtgtgccaaccaatcccacaatggttatcagcagcaggccaacaagcagcagaaaagtcatactgagccttttgacccacctcatagttcagcccctaaaccgatgtaaaactcaataccatgattgcttgcgtctcctactggcgtcgcaagatcaaatttaattggcccaacgggtgaggcccaacgcacaccaatccctgcgccggttttaaaatcactctttttaatatcatccaccgcttcgccagtatccacaaacaacgcactccaccagtttccatagatattgtattgatattccagtgagccaacggctagtttcgatgccccagtcagttttccctcactatttttcggtgaaattttttggtatttataaccacggatgctgcgatcccccccggcgaagaaacgtaaacccggtggaactttgttgaattcattggtttcaatccagcctagatcaccccgtaccacaaagcggtgcttatccttataagtcctgatccagacgtgatgggcctgtaacaccaagaaatccacattcgaatcccaggttttgtcggaaaaatctattgaataacgctgactatctccccaataaggcatagtgccaccacgctggcgaattcggctgacagtcgctcccggatagagtagcatcgtcgtatttgtcacgttagcctgcgtaaagtgactaagactccagcgtaagttgacaccatattgccatccggtgaagagatcccaattgcgggaaaggttcaatgttgccgtatcagaaatggtatcgttaatatctttacgtttataacctgtctgcaactcataatattgttcaagcggattagatttgagtggcattttgtaggatgcatcaataacttgttcaggtgccgacaggttaatattggtactcaggctatgcccacgagagttaagccatggctttttccattttgctttaacgcgggggccaacatccgttgcataacctccccctagttcaacataattggcagagctgggaaccaagaaagcatccagtggcaataacttatcctggctcgtgtggcctaccttaaaatcaggcacgaccaccacagaattgaaccatccggtattcgccagacgactgttgaattccgcaagttgatccgaagtgtaatactcaccttgtttaaacggcaaaagattgttcaggtaattttcacgaatttgcgagccgtggtatctcacggagccaaagcggtaacgatctccgctgtcgaaatcgaagttccaataggatttatgctgctcctgtgatacttctaattcactttttttcatcacagcatcaaaataaccctttctaactgccagactattcaatgcacccttgaaatgttcgtattcaccatgattcaggatcgccccttcctttggcatattttttttgatgagtgctgcataatctttatcagtttttgcgctaccttccaaatcaacattgacttcgactacccgtaccggttcacccggtgtcacgttcgctgtcaaaacagggcgggaaggtggtgttttctcctgataagtgaattcaacagtgggatcgtagtatcccaatggccttaacccttgctgtatggctttctcgacacgggcctgaaagcgcgcatcgggagcgacttcctcggtacttatgtttgagagctgtactctggcatttttttccagttcgccagaaagaccttccactttcaatcgtaaatttgcactataggccgatggagttgcgacagacacgcaaagcacaaatatgaaggggtatcgtgacacgcaaactcctaatatttatctatctgggggtaaaatccaacgatataaaaatgctgcaataaattaattctggtaaagtttgaaagatatacaagcaactaataaccataaaatctataaataacgggagagaatcttgccaaattcagccaacgaaagccaacatgtttccacacaggatgcattactgggtagggcaatcccattaactgtatcaccctaccatgtcatcacacagcattcgataaacgacattcctgaaaacatggagatagcctatataggaatggggtgtttctggggagttgagcgcctgttctggcaacaggaaggtatctacacgacctctgtgggttacagtggtggtactacgccaaatccaacttatgaagaagtctgcacagggttaaccggacatgccgaagtagtcaggatcgtatttgatccaaccaaaatcacttatgggcagttattgacgcttttctgggaaaatcacgatcccgcccaaggtatgcgtcaacatggtgatatcggtacacagtaccgctctgccatttatactatttcatctcaacaatatgagcaggcactcgctacccgcgaacaattccagcaagcgatgaatgaaaatggcgaccagcgcacaatcaccacggagatccacgcagcgaagccattctattttgcggaagattatcaccagcagtatctcttcaaaaatcctgaagggtattgtggactcggtggtattggggtatgcctcctccctacgcacaaaaactagccgatttagtcagctcagtgttataatcattagactaaatttatatatcttacggtaaaatgccgtaagattttatttgtataatttttcatctcccctccggtgttattcaaataaaacctgccctaccgctggagataaaacacgggtgccttatgttaaatagtttattaataatacttttgctatgtgcaatcagcgcatttttttcgctatctgaaatttctctggccgcctcaagaaggatcaaattaaaactcatggccgatgaagggaacctcaatgctgcccatgtgcttaagttacaagaaacgccaggcatgttctttactattgttcaaattggtctgaatgcagttgcgatcctcgcgggcgtcgtgggagaatctgcattttcacccgccctgaaaacactattctcgaacttcatgcgtcaggaatgggccgatcaacttggctttatctgttctttcattatcgtcaccagtttctttattctgcttgctgatttgattcctaaacgtattggcatgattaagcccgaagccgttgcagtgagaattgtcaatccaatgcgtttctgtctggcaacttttcgcccgctggtatggctgttcaatggccttgctgactgtttcttcaaaatatttaaaattcctatggcacgtaatgaagatatcacttccgatgatatttatgccgttgttgcagccggagcgttagcgggtgtattacgtaaacaggagcatgagctgattgaaaatgttttcgaactggaatcccgtaccgtgccttctgccatgacttcccgtgaaagcgttatttattttgacaagaatgaagacgaaaacagtatcaaggaaaaaatatccacccatccgcattcaaaatttctcgtttgtgatggcggtattgaccatgttactggctatgtggattccaaagacttactcaaccgtgttctgaacgggcagagcctcagcttgaaagatggtgttcaaacccgcaatgccttgatgattcctgatacgctctcactctctgatacgctagaaagtttcaaagcggctggtgaagattttgcgatcatcctcaacgagtatgcattggtgatgggagtcattactttgaatgacgtaatgaccaccttaatgggcgatttagttgatcaggggcaggaagagcagattgttgtccgcgatgaaaattcatggcttgttgaaggtggcacaccaatagaagatgtgttgcgagtactggatatcgatgatttcccagactccaacaattatgaaaccatcgcaggatttatgatgtttcgcctgcggaaaattccaaagcgtacggattttgtgaaattcagcggctacaaatttgaagtggtggatattgataattacaaaatcgaccaattgctggtgacgaaaattgtggacacgcctgcccaatccaacccatctcccagcagtcaagcacaggtccagtaaaaaatccgatcaaaaacggccgcgaggccgttaattatactcatcatgcgctgtcaactctgacacatatcgttcggcgagttagccgttacagaaaaactaccccatttcggcctgtaggcgcaacacctgctgattaatttcactcattacattcaagtgacgtttatcttttatcttgggtggcaagatcttcccgtagttaaattcaaaagcgcccatgtccttaatatacaaacgcccacgaaatagagtttttacgtaaagagcaactttcagtgggttataatggtgaaagattttcatttatttttttctcctcccattctgcttacgatactatttcttctgcattacaccatcagtgaagacacatcactgttgtgtaagatgtatagactacacatatagaaatttgttccctgattttaaatgattcaatcactcattttacgtaacgtaatgaaaatatagagcattatgttgctttaacatggaattgccttatattttgtttcaaatgttatcaatttgtttatttttatgaggacagaccagttaacaagcgctatgctgaatgtgatgttccctgataacatgcttcaccatgctaaataaggaataaatatgataaaaaacattatgttatatgcaatactgagcttaacttcagtattcgcatctgcccataacatcgcagtaggacagccagtccctacggtcagcgtgacagataaaggtgagttactgctcaacaatgacaagttcagctaccaaaattggaacagtacagaacttcctggaaaagtaagaaccatccagcatattgctggccgcagttctgcaaaagagatgaatgatcctctgattcaagcgttgaaacaagccgaccttccaaaggaaaaatatcaaacaaccagcatcgtgaatactgatgatgctatttttggtaccagcgtcttcgttcgtaatagtctcgaagacagtaaaaaagagtttccgtggtcacagtttattgtcgatagtgaaggtttagctaagaaagcctggggtctggaacccaaaagttcggcaatcatcgtgttggataaaaacggtaacgtgaaatttgttaaagatggtaaattgagcaacgaagacatcacccatgttctcaatctgatcaaagaagaattgaacaactaacctgtagttccattaacaccttagtaattataatttagtcataatggttccaaaacaggaaccattatcaccttaataatgaagaaactaataactaaaaaatagtgactctgaaccccggattcagaaaagattcacgcggcgcgtaattgagcttcttaccttcccaatccgtgacatgtgcacctgcggcaatcgcaacagcgtgacctgcggcggtatcccaaatattagttggcccaaagcgcgggtaaagttgagcttttccttctgcaaccatacaaaatttaagtgaagatccgaccgaaactgtctgatgggttcctaattgagtaagataatccttcaattcctcgtctatgtgagaacggctgatcaccacagtcggcagcactgcagcagcaaccttaataggaattgtctgcccattggtttccttccaagcctgatgtccctgccctgcgtacaaaacattcagcacaggaacataaacgacgcccatcaccggaacaccatcctcaatcaatgcaatattaacggtaaattcaccgtttcgctggataaactctttcgtaccatccagcggatcgaccagccagtagcgctgccagtttttgcgctcctcccatacagggggatcttcttctgacagcaacgggatatccggtgcaatacgcatcaaccccgctttaataatcttgtgggcggcaatatccgcagcagtaacaggtgaatcatccattttatgctctactttcaacggctgctcatcctgataaaccaccatgatggcagctccagcttcccgcgccaattggcagatctgttgtagcatcatacacctctgcattcattattcagctataactttagattacatttttagcgtattttgtactggaatagcgaatactttatctcaaaaaacgcgcaaaaaaatagccggataaccggctattttatggatgaaagataaaattacaggatttccagtaattctacttcaaagatcagtgtgctgtaaggaggaattgacgcgcctgcgccacgctcaccataagccagattatgagggatatagagttcccacttggaaccaacaggcatcagggtcagcgcttcaatccaaccaggaataacaccactcactgggaattctgctggtgtcccacgctgcacggagctatcaaacacagagccatccatcaggcgaccagtataatgcacacgaacacggtcactacgagcaggtatcgcaccatcaccttgtgtcagaacagagaactgcaaaccagactctgtgctgctgacgccttcacgttctgcattttctgccagaaactttttgccttcttctgccatcgtctgctgatgttcatgacgaacactatcagcacgttcatgaatttcgcgcaacgcacgatgcagttcttctacaggaatagccggagaacgattttccagagcatcacacagacctgccagtaatgcttctggttccaatccctgtaaacccgattcctgcaattgttgcccaacctgtaaaccaatgccgtaactcgcccgcgcttcaatagactcaaaagaaggtgttgtcatgaaaatacctgttattaaatgaatgaagactcaagcataacagccctgccagaatgggtaaacgcgcgaaggattttaatcgagataggtaatgaaaaaatacaaacaaaaaacgctggcattgccagcgttttttgtcacatgttcgctttagctaatcaaagattaagcttcaggaacgatgttaacgttcaactgtgcgaatacatcgctgtgtacctggaagtgaacttcgtgctcaccagtggtacgcagaacgccgttagacaggcgaacttcgctcttagataccgcaacgccagcagcagaaactgcgtcagcgatgtcacgagtaccaatagaaccgaacagtttaccttcgtcacccgctttagaagcgatggtgacagagcccagtgcgttaatttgtgctgcacgagcttctgctgctgtcagaacgtcagccaatttggcttccagttcaacacggcgagcttcgaagaattcgatgtttttcttagtcgcaggaacagctttgccctgtggaactaagaagttacgggcataacccgctttaacgttaacttggtcacccaggctacccaggttcgctactttatcaagcagaataacttgcattaccttatcctctcaaagtcgttaatggactgagcctattactgatgacgatcagtgtaaggcaacaaagacaggtagcgcgcacgcttgatagcacgagcgagctgacgctggtattttgcacgagtgccggtaatgcggcttggtacaattttaccgctttcggtaatgtagtttttcagcgtaacgatgtctttataatcaatctcttgaacgccttccgctgtaaaacggcagaatttgcgacgacggaaataacgtgccatttggctagtctccagaatctatcaattcaatctgctcggcatgaagaaccagtttactaagaccattacgcccttgatggctattaatgaatcctgaaacggttattcggctaccgaccgttatactgtgagtgaactcttgtaataactgtccgctggcaataacgggcactttgcaccatgattgcctgctacatccggcttcctgctgttgtgaacgatgttcgagcacaaactggcaatgaggaataccggatgggctgacttttcgtatcggcactttgcacactgtgccagaaagcaccaaacgattagctgccacagtaattactcttcagagtccccagcttcatcagcatcatcagccatgtcttcttctaagaccaggtcacggctacgacgttcgtctttagctttaaccattggtgatggttcagttactgcgtgcttaacgcgcataaccatgctgcggataacggcatcgttgaagcggaagttagtttccagctcatcaatcgcttcctgtggcgcttcaacgttcagcagaacgtagtgagccttgtgcagtttgttgattgggtaagccagttgacggcggccccagtcttccagacggtgaatctgaccttgcgcgttagtgatagtcgcactgtaacgctcgatcatgcccggaacctgttcgctttggtcaggatggaccataaaaacgatttcgtaatgacgcattagcattgctccttacggattattagcctcctgtcagggtcagccgtggcccatggaggcaaggaacgtgttgaatacggctgaaaaatcgacgcgtaactatacccgcacaataaaaaaaactaaggtacgggtgaaagaaaaaacgcgtttatccttaattccaataatgccccaatgaaatgtatcatgcgggacaaaaaaattactgggcgcttctctgacgcatgatttcaaacaagcaaaccccggtcgcaaccgatacgttcagagaagaaacagaacctgccattgggatactgatcaattcatcacaatgttcgcgagtcaggcggcgcattccttctccttcagcacccatcaccaaggccaccgggccagtaagcttgctctgatacagagaatgggtagcttcacctgcggttcccacaatccagatattgctttcttgcagcaaacgcagagtacgggcaaggttggtcacccgaatgagcggtacgttttctgctgcaccacaggcgacttttttggtggttgcattcagttgtgcggagcggtcacgaggaataatgactgcatcaacgccagcggcatccgcagtacgcagacaagccccaagattatgtggatcagtaacgccatccagtaccagtaaaaaagggcgatctaactgtgatagaaaatccggtaaatcgctttcctgatactgacgcccaggtttaactttggcaatgatcccttggtgtaccgcactttctgtctgagtatccagccattgacgattggccagttgaactgtaataccaatatcttccaattcccgtaacaatggggttaagcgacgatcttcacgtcccttcaatacataaacttccatgaatcgctgaggttcgcgatccagtaaggctttaacggcatgaataccgtagataatttcactcatggctggttgatacctaactcactgatatcttaaatgatacctgaaaaatggagggcagcagaagccgccctgattctctgtatttgtcagcttttttcctgcgtttttttcacgcgtttcgctttcaattttgcagtaatctttttggttttgtctgacgttttcttcttgcttgctttaggcttttccgcttttttctttttactggaggcgttgtctggctcaaaattggctgattttttatgatcatacccttttttgccactgttacgttctggtgtgcctcttttcgatttatcgcgcgcggtcttaccttgattacgcgcctttcgggtcgaagaaagcaaggtgaaatcaatattgcgttcatccatgtgaaccgcttcgacacggatctctacttcatcaccaagccgataagtctgaccagaagactcaccaatcagacgctggccaacattatcatatctgtagtaatcattatccagtgttgaaacatgtaccaagccgtcaataaacagctcattcaacctgacaaagaaaccgaaacccgttacgctagtaatcaagccagtgaaaacattgcccacttgatcctgcataaaatcacatttcagccagtctgccacgtctcttgttgcttcatccgcacggcgctcagtcatggagcaatggttacccaattgcagcatgtggtccatatcgttatgccagccgccagttggtgtccaatgctgttcaacgacaccattctcttgtgccaataagtatttgatcgctcgatgcaatgccagatcaggataacggcggattggcgacgtaaagtgcgcataagaactcagagccagaccaaagtgaccacggttttccggatcataaatcgcctgtttcatagagcgcagcaacatggtttgtagtaattcatgatccggccgttcagccacatctttcatcaattgagcgaagtctttcggttcaggtttcattccacccaataagctcaaacccagttcgttgaagactgaacgcagatttaagatactttcctctctaggctgatcatggacgcggtataacgctggctcattatttttctcaacaaaacgtgccgccgcaatattggccagaatcatgcactcttcgatcagtttatgggcatcattgcgcgtaacgggttcaatacgctcaatgcgacgttctgcattaaaaataaatttcgcttcttcagattcaaacgaaatggctccacgctgctcccgtgcttgctccagtgcctgataaagttcatgcagatactcgatatgtgtcaccaacggctggtaatgctcacgcagctcttgatcaccctgcaatattttccataccttggtgtaagtcaaacgggcatgagagttcatcacagcttcatagaacttataagaagacagcttgccttgggcagaaatggtcatttcacacaccatacacaagcgatcaacttctgggttcagagaacacagcccattcgacaaaatttccggcagcatcggtacgacttgagatgggaaatagactgagttaccacggctacgcgcctctgtatcaagaggtgtttgcggacgaacataatagctgacatccgcaatcgctacccataaacgccagccgccgccacgttttctttcacaataaaccgcatcatcaaagtcacgggcgtcttcaccatcaatcgtaaccagtggcagtccacgcaggtcaacacggccttttttcgccgagtccggtacattttcatcaagatcaaccacctgtttttctaccattggtggccagctatgtggaatttcatgggtacgaagagcaatttcaaccgccatgttcgttcccatcgtttcaccgagcacttcaacgatcttaccgatagctttagttcggcgggtcggacgactcgtcaattcaacgacgacgacattgcccattcttgcaccgcaaatttcttcttttgggatcaaaatatcgaaacttagccgactgtcatcagggacaacgaatcccatacccgcatcgacaaaatatcgcccgacaatctgactgttttttggctccaatacccgaacgatacgcacttcaacgcgacctttacggtctggttgcaaaggctgtgccaatatgacatcgccatgaattgccattttcatttgttctgctggcagatagaaatcttctttgtggccttccgcacgcaggaaaccgtaaccatcacgatgtccaatcaccgtacctttcaacaaatccagtctttccggcaatgcataacattgacgacgagtgaaaatcaactgtccatcacgctccattgcccgcaggcgacgtcgaaacgcttcctgtgcatctgcactggttaactgaagttcttttgctaattcctgacggcttaccggagtggtgtgtttagaaagtatatccaagatgtattcacggcttgggataggagattcgtatttttcagcttctcgttcctgaaaaggatcttttgacatcgtaattcctctgttgtcatcagcaagctgttgctccccgtgcttcattctcgcttcacttagccagaagcaactgataaaggggacgattatctttgaccatatcagccaaagtatgtttatccaactcttgcaaaaaattttctaccgcttgattcaacactaattttaagcgacatgcgggcgtgatatagcaagcactacagttaaccaatgaaagcggttccagtgaacggactacatcgccaattttgatctcgctggcaggcttacccagactaatgccgccattttttcccctgatagcattaactaggcctaaattactgagctggttaattatcttcaccatatgattacgtgaaacaccataaacttcagttacttcagtaatgctagtcatctggccttcaggcagagaagccatataaatcagggcgcgcaagccataatcggtaaaactggttaactgcacacttacctctggacgaccggatataacagcggttatttagaaccaagaaataaaatatatgtttattggtttatcattatctgttcacattatgtgggcattttaaaaattaagcaaaacgagctgcgttttataacctctcacccaaaagcctatccccaaaaagtaaaaaaccgggcataaggcccggttatacatgcttaaaagattaaactagcaatcaagcatcaaatggatcacgcaggatcatggtttcagcacgatctggaccagtagaaataatatcaacaggaacgccggtcagttcttcaacacgcttgatgtagctcagtgctgcttctggcagcaggctgtgatctttcacgccaaaagtgctttcatcccaacctggcagagtttcatacactgcttcaagaccttcccagttttctgctgccaatggtgtagtgtcaatcacgctgccatcaggcatacgataaccaatacagactttcacttctttcagaccatcaagcacatccagcttggtcatgcagaaaccagacaaggagttgatttggatcgcacgacgaatggcaacgatatccagccagccggtacgacggctacgaccagttgtcgcaccaaattcctgccctttctgacgcaggtactcgccggtttcatcaaacagttcagttgggaatggacctgcaccaacacgggtagagtaggctttgataatacccagaacatagtcaacgtagcgtggccccagaccagaacctgttgcgacgccacctgctgtggtattagaagaagtcacataaggataggtaccgtggtcgatatccaacaacgtaccctgtgcaccttcgaacatcaccagttcacctttctgagttgctttatagagcagatcagaaacgtcaactaccatgtttgtcaggatatccgcaacagccagaatatcatccagtgttttctgataatcaacagcaggctcgttgtagtagttaaccagttggaagttgtgatactcgatgatttcttgcagtttgaccgcgaaagtttctttatcaaacaaatcgcctacacgcaggccacggcgtgctactttatcttcgtatgcaggcccgataccacggccagttgtaccaattgccttggcaccacgcgctttctcgcgggcattgtccagtgcaacatgataaggcaggatcaacggacaggcttcagaaataagcaggcgttcacgtacaggaatcccacgtgattcaagcgcattcatttctttcatcaaagcatctggtgctaaaacgaccccatttgcgataatgctaatgacattttcacgcaagatcccggatgggattaagtggagaacggttttttcaccgttgatgactagtgtatggcccgcattgtggcccccctgataacgaaccacgtacttagctcgttcagtcagcaagtcgacgattttacccttgccctcgtcaccccattgggtgcccaatacgacaacgttcttacccatttcaaaagttcactcggttgcttaaaaatggattctaccatctcatttagcacctttcagtattttttctcacttctgttatttcgtttcgtcatattaacgggctgttaagtaagcattcgtaatgatgctagtaacaaaaaagccactgcaagttttcttacagtggcttaggcagcggttattcattccgccgcgttagatttctttttgttcattaataaggcaattcgcctatctgaacgactcagtcattggtattactgtgctgcttaaatggcgctttcatataacggaagaaatcgctatctgggctgagtaccataatgttattgccatcattcttgaagctcttctcataagcacgcaggctacgaatgaacgcatagaattcaggatctttgttgaacgcatcggcaaacagcttggccgcttccgcatcaccttccccacgcaggataagtgcctctctattcgacttagctttaatttcagttgctgttttatctgctactgcacggatcttttcagcttcttccagaccttgtgagcgcaggagacgtgcctcagcttcacgatctgcacgcatacgctgataaattgcttctgaaatttcctgtggcaagttaatctgtttgatacgcacatccacaacctcaatgcccagctcggccatactattctggttcagaatgggttgtttgtctttcgtttcctgcccgacattagccgcagccgaagcaacaggattatccgctgtttctgccgtgccaccatcatttgttcccaagttcaaggaattacgcacatcggtagttaaacggccacgggaatccgtcacaataccacgcacatccaaacgaccgatttcagaacgcaaacggtcactgaatttacgctttagcagcagttcagcctgagcaatttctccattacctgtcgccagataatatctgctgaaatctttaatccgccatttcaggtaagaatcaacaatcaggtctttattttcacgcgtcaggaaacggtcagctttgatatccatagtctggatacgggcatcaagtgttttgactgtctcaataaatggaattttaaaatgcagaccaggctgataaaccagtggtttattttccgcatcacgcgcaaccttaccaaaacgcagtacaataccgcgctgaccttcgtacacgatgaatatcgacgtatacaacacaaccaatataatggcaatagcaaagacgaatgacttacgcatgattatggtctcccttgtcttggcgtctcaccacgcaggctactgggattgccatagctagaatgattattactggagttgttataacctgtttgtccttgttcaggtgcaaaatgtgtagagccgctcttctctggcgctactttggcatctgatgactgcgttttcggtacttcagcttgtttacgaaaaacctgatccaatggcagtaccagcatgttattgctcttttcgtttgcaatgaccttacgggtattactcagaacatactccatcgtttcaatgtaaagacgctcacgggtaatttccggtgcagctttatactcaggcagaattttggcaaaacttgccacttcaccctgagcattcaataccacactgactttataggctctggcatcttcaatcatgcgttgagcatcacccttagccataggcaagacagcatttttgtaggattcagcttcacgaatggttttttgctcttcctcacgcgctgcgataacatcatcgaatgccacttgcacctcttctggtggacgggcagtttggaagttaacatcaagcagcgtgatccccatgttgtatggacgaatggtttcttccagtactttctgggtatcgttacgcacgatggtacgatctgccgtcaggattttttccatggtgtatttgcctacaacaccacgcactgcgctgtcagtcgcttggctcaggctgttgtccgggctggtgacattgaaaagataagccgcagggtcggtcacacgatactgtacgttcatttcagcacgcactacgttttcatccgatgtcagcatgacacccgatgtcgccagttcgcgaacagattcgacgttaacggctcggactcgatcgataaacgtcattttccagttcaagccaggctgcacaacatggctaaatttacccaatcggataacaacgccacgctctgtttctttgatagtatagaacccacttacaacccagacagcaacggcagcagcaacggcaagaccaataatacgtccaccaaatttaggaccctgctcagaaccatttccacctttttttccaccgaaaccaccgagtttttcactcagcttacggaatagatcgtcgagattagttgccccacggtttcgaccacctttattgttgccgccggagttgccgccattattattgctgcttccccacgggtcgcggtcctgtccgttattaccgggctgattccacgccatgttttagctccactttttagtttttcactggtttttcagaggtgactgctctccaccctaacggatgaggcttcccacttcacaggccattgcctgtccctgacaggtctgacagcggcctctgtgggcagaaacgacaaatttcgtcgttttgtaagcaaccaatatttttgggtgatgcttctgacagtactgattctgtcacagtcatttcatcaccgccatcccattacagctactacacgactataaacgccttgaaatggctgacaaaatgataccttgtttgtcttcctgagccaatcaatcagacaacatagtcaagtaaattcaattcttgtttacatagtcggcgccaatcaaccatcggcatcctgacttcaataccaatttgaccaccgtcttctatccattcacgctcaatggcctgaagctggtaaaaacgactgcgcaaacgccctgcctcaggcggcagatgcaattcatagtgtgcgatttcacctgaaagacattcggtcaacacctgaaataacagagggatacctgctccagtttgtgcggataaccagacccttatcgggcggttttcctcatcgcgatcaatgcgtggaacaaaatcttccaacatgtcaattttattcatcaccaacaaggaagggatctcattggcttcaatttcttccagaacactgtccactgcaacaatgttttcatccaaacggctgtctgccgcatccacaacatgcaacagcaatcttgcctgccgagtttcctgcaaagtagctttaaacgccgcaaccaaatcatgaggtaagtggcgaataaaacccacggtatccgccaaaacaactgtaccgacgtcatttacgtctatccggcgcaaagtgggatcgagggtagcaaaaagttgatcggcagtatacacctcagccgaagttatccggttgaataaactagattttcccgcattggtataacccacaagagaaacagtgggaatatcagctttattacgtgcctgacgcccctgctcgcgctgtttttcaactttgccgagacgccccagaatctgcttgattttgtcacgcagcaagcggcggtcagtttctagctgagtttcccctgggccacgcagaccgatcccccccttctgacgttcaaggtgagtccagccccgtaccagacgggtagataaatgacgtaattgtgccaactcgacttgcaacttaccttcgtgcgttcttgcccgttgggcaaaaatatccaagatcacacccgtgcgatcaacgacacgacattggcaaagacgttcaagattacgttcctgggcagggcttagtgcatggttgaacaagaccacatcagcaccgctgttcttgacagcctcagcaatttcctctgccttgccttctccgacaaaatatttcggattgggcgcctttctgcttcccgtcacaatctgcacaggagaaacaccagcggaagtcaccaatgattcgaattcactgagattttccgtatctttttcctgtgagaaaaaaacatgcaccagaacggctaattctccgccttcataacgatcaaacaacggtgcaacccctcaggctaagtagaaatccataggaaaaaacataggtaaagtctccctacctatgtttttatttacgtcaggcacggacactgatttattcagcgccatcactttcctgtggtgctgctgggttaacgccagcatgataatttccaacgccagtcgtcacgttcggattattgccgtggtgagacacaggacgggaaggcacaacagttgaaatggcatgtttataaaccatctgactgaccgtgtttttcagtaaaatgacaaattggtcaaaagattcaatctgaccctgtaatttgatgccgttgaccaaataaatagaaaccgggaccctttcacgccgtaacgcgttcaggaatggatcttgcaaagattgccccttagccattctatattttccttattttgttgttcttaactaagaacctgttggttcgaaaaagtaactactcaaaaataacgctttgtactgatcaattgtacacaatcaatgaatttatgtactaataacctgcatcactgtattcaatgcctgttcaggttggtcactgtccaaccaagtcacattgtcccagcctcttagccacgtgatctggcgcttcgctagctggcgtgtcgcacagatgccacgataaaccatctcatcatgagagatttcgcctgaaaggtaagaccacatttgacgataaccaacacaacgaatggaaggtaaatctgtatgcaaatcactacgagcataaagtgcttttacttcatcttcaaaccctgatttgatcatttgttcaaaacgggcggcgatgcgctgatgcaaaatttcacggcttgcaggtgcgatcgcaaattgatgaacacgataaggcaatatttctccagacatttcagtcaatgcagttagagttttacccgaaattcgaaaaacttccagtgcacgagtgagacgttgtggatcatttgggtgaattcttgctgctgcaacggagtcaatttcctgcaattgccgatgcaaggcttcccacccatgtttggccgcctgttgctcgatctgcgcccggatctcaagattagaagagggtaaaggcgataatccttccagcaatgctttgaaatatagcatggttccgccaactaggaggggaattctcccagcagccgtgatatccgccatttctttcagagcatcacggcgaaaatcagcagcggaataaatttcagccggatcgagaatgtcaaccagacgatgaggcgcctgtgcctgctctgctgcggtaggttttgcagtaccaatattcatttcacgataaatcaacgcagaatcaacactgattaattcaacaggaagatgctgatgtaaggcgatcgataacgccgtttttcctgaagctgtcggccccatgatgaaaatggctgtcggtagatgttgagtttttaaatcactcatgattgagaagtgccaccactgcttgtaaatcaattaactgtaataagccctctggcggggattccaccaattgagggcaaagacgctcgacgtcagctaaaagctggacggcttgcgcaatgttccacgtttcatgttcgctcccaacgtgacgggagagccaaatcgctacctgttcagcacaggccgagggttgttccactagatagttcaacagctccggcaggagtttcggcaggttctgttgacgcagtggcaacgataccgcatgaatagttacttttccatgtgcgactgtagattcaataccgaaagtcttcaatagctcactattctgctttaaagcgtcgatttctgcctgactgagagacagtttcagcgggatcagtagcggctgcgatttaagccccagctcccctggcgtcaactgcacctgtttcagccagcgttcagcaactggcaaagacagtagcccaatccccaacggagactcaatcaaggcataactggcagcatggatgctcaataccttgccaaaactgtaactaatgttttttccctgcaaaagtgcggcaccaacaggaatcggagcggctttttccctcacggagacagctctttcaggaaacagcggccgtttctcctctggtgcagattgcatcattttctggtacaactcgccctgtttcttctggtaattttccccatgatgaagttgccgcgtatcattgccagaatgcgggcgatcaagctgaggctgttctttgtcatgccctccagatgaaaccgagggggcagccgcggcgcgggaaggcggtgatgccttcagtgaagccgtattttgctggagaaaatggttctctcccgcagaaagacggttttccggcacccaactggcagccggctcctcacaaccaagcgccagttcagctcctttccccctttgtttcaatactgctgccacaccctgataaataaaatcatgtaccagacgtgcctgatggaagcgtacctcatgcttcgctggatgcacattgacatcaacctgatgcggatcaatctccagatacaatacataagcaggctgcttctctccctgaagcaaatcttgataggcctgacggatagcatgattaatcagccgatcccgcatcatacgtccattgacataacaatactgaatatcgcccccgacagtatcactcatgggatcagcaacccatcctttaatagacaaggaatcatgctgccacgacagcgcaagagcctgctgcacaaacgccattccgcaaatggccgccaaacgtcgctcatgctgagattcttctttcgctggacgatactgacgaaccaatttgccgttgtgatgcaggttgatcgccacatccaaccgtgccagagctatcctgcgcaccacttcatcaagatgcccgaattcggttttttctgttctcaggaatttgcgacgtgctggcgtattataaaacagatccaatacttcaaccgtcgtaccgacgggatgagctgcgggttttacggtgacttccatatcacggccttcggcgtaagcctgccacgcttctgtctggctttcagtacgggaagtcagagtcaatcgtgaaaccgagctgatactggccagtgcttccccacggaatcccatactgacaatcgcctccaaatcatcaagcgaagcgattttactggtggcatgacgtgccagtgctaatgtcagatcctgctggtctatcccacagccgttatcacgaatgcggattaatttcgcgccaccgcgttcaatctcaatatcaatgcgggtagcgccggcatcaaggctgttttccaccaattctttcaccaccgatgcagggcgctcaaccacttcaccagcagcaatctgatttgctaattgtgggggtaaaatcctgatagccatattcaaccttctttacggtttagtattacattggagaagtctgcaacgggttagcctgaaaatagtggcgcagcccaaagtgaatggcttgtgccagtctcgcctgataatcgttagatcccagcagttcttcttccgataaatgactaataaaacccgtttccaccaagatggaaggaatatccggggaacgtaatacacccaggcttgcatgttctggtctacgcttatgcaaagagccaatgtgagataactggctcaatacttgaacagcaacgtcatagcccactctctgggaatgaccaaactgcaaatctaacacagcctgactcaatagcggattaataccattggatagaacatctcccgcaccgcccaacaattccgattgtttctcgtgctgctccagccaattccccaattcactgtttgcgcgacggttggatagtacccaaacagaagcccctctggcgctgcggttaggtgctgcatccgcatggatagacaccagcatattggctttgtgcttacgggcgacctcagaccgtccggcaactgagatgaaataatcgccacccctcgtcaaaacaggcttgaacatgggatcattgtgtaaaagtacttccagcttgcgtgcaacgctgatggtcacgttcttttccttcaatcccccttgcccgatggctcctgggtctgtcccaccatgccctgcgtcaatggcaatcacaatcggatattttccctgtgctgccttagttgcctgctttttcactccttggtcatgatgagccggagtttgctttatctcctgcttcggtgactgagcattattagctaataactgcttactttcatgtaatgaagtatttcccttgagcattgaggtgctattcgttgtacttttagccgttgcactattagttttcaacgtaaacatcacctgatattcactggcggattctttcaccgaagaagtcgcggtagcctgatgtgccaattccaatacaagccgcttatgctgtgcatcaggggactgactggttcgaatcactttcaccagattctggcctgataaacgcatcggcagtcccatgacatgaccagactgacgaatatccaccaccaaccgctcaggagcatgcagagggaaaaaccgataatcaggatgcccgccagtgaatcccaacgttacggtagcttcagatgggctattattcacatgaatattcgacaacgtagccgctgtcgccgtcatcatgatcagttgactcaacatgacaaacaatacacaggacatcacccaatgggcttgccatttctttattactttcacaaagaaagcattcatcatggtcgggtattccttcataaggacttcagattatccagcagattttcaccatattcagataacgcgacaaaacgcgcgcgccgcccttcgctgtcatagctcaaatgcagctcaatatcggcatcaggtaaaaaccctgcaccctgttgaggccattccaccagacaaatagcatcctgatggaaataatcacgaatgcccataaattccagttcttcaggatcagacagacggtaaagatcaaaatgatagacaggccgcggtagcaaagcataaggttcaaccagcgtataagtcggactcttcacatgcccctgatggccaagcgcctgtaggaagccacgactgaatgtcgtttttccggcacccagatcgccatataaataaataacatagccgcgatcgccggttgccgccactgcattgcccaatgcaaccgtggcattttcatttggaagtaataaaacgagttctttcatcgaaaagtatctattttatttattgaattagagcctaatgagatttaggtttatcagttaaatagtttaaccaataaccataacataactcagccattatcatttaacatcttctgctccgccgtactgccacgtaccgcactttttgtattcaatccgctgtgtgctaaactacgtcccctttgcagcagtaatttgatattcaatggcaacccctcttgatctgaatcttctggcaacaaacatcaaacaatggagcctttcccttggctttcaacaagtcggtatctgtgacaccgatttatccgcagaagaacccaaactacaggaatggcttgataagcaataccacggtgaaatggattggatggctcgtcacggtatgatgcgcgcccgtccccatgaactactacctgacaccttgcgggtcatcagcgtacgcatgaattacctgccagccaaagcagcttttgccagtacactgaataatcctgaattaggttatgtcagccgctattcgctgggcagagactaccacaagctattgcgtcagcgactcaaaaaactcggtgaacagattcaagactattgcagtgctcatgaatatcagggaactctgaattttcggccttttgtcgattctgccccgatcatggagcgtcccttggcggccaaggctggtctcggctgggttggtaaacactcacttatattaaatcgagaatcgggttcatggtttttcctcggagaattgttgattaaccttccccttcccatagatgccccacaagaggagcaatgcgggcgttgcgttgcctgtatgacgacctgcccaacaggtgccattgttgagccttataccattgatgcccgacgctgtatttcttacctgaccattgaattggatggtgtgatccctgaagaattgcgcccgttaatgggcaaccggatttatggttgtgacgattgccagcttatttgcccatggaatcgtttttcacaattaacggatgaagtagatttcagccctcgtgctgccctgcacacgccaaaattacttgatttattcagttggagcgaagaaaagtttctacgtattacggaaggatcagcaatccgccgcattggttatttacgctggctgcgcaatatttccgttgctttaggtaatgctctttatcaggatgatatcgtgctggcactgaaaaaaagaatcggtttaagtgaagtactggatgaacatatccactgggccatcgatcaacaaataactcgccgcaatgccaatacgattgaagttcaaacatcacagcagaagcgattaattcgggcaattaccaaaggaatacccagagatgcttaataattaaccagtcgaatttattgtcaaaaaacccgtctatttccttgtgaataaaataaaaatgccttgttgatcaacagacaaataaagtttaaatattaatcaatgtcattttaaatgaaataaattattttaatttatcaataagttaaatatgatttattattttaaataatgggtcaaaaaatacagatacagaaatttcgcctgtggataactctgtgcagcaaatagagcatcgtcagacaagtcaatatggcagtaaggttaaatactgtggataaaaaacagtaattgtatttcagtggaaaagaatcagaaataagcaataaaaccagaatccactcacacattctagacgctggtgaagaaattttcctctgcctattcaaaaatgaggcggcattatggacttgttgtatctggatagcaagtgctttatcgacaatttatttatggtagtgatagatggtacggatcaggtagttactccctgcgatagatccccccaaaggagaaaaaaggagaactgcagcagttatgccaattgtgataaacacgagagtccagcgaagttgtttcgtagcggcgctgccagaaagaaaattccccgctattccagcaaggccgtaggcaaacaaaagtggattaatccagctattatcgaacttgtagacggtctggagcagtggtcgtacatatgtgtacgccataaaatgaccaacgaccagaaaaacgtgaccaatatccagaatattgacctgcttctttatggtcttgtcaaagacaattagctgaaatatcaggatttcatgaaaatcagagaggtgattagccccagaccgtcagcgccggaatagttggcgcttttccgacaggcttggcttgccagataataagaaggtatcatcagatagctgctaatcttagcaggattaatcgttattaaatttcgatgaactttgttgagataggaaatatgggtcaggctattatttcagagacatgcaagaaatcagtagaagtttatagataagatattggagcgggaaacgagactcgaactcgcgaccccaaccttggcaaggttgtgctctaccaactgagctattcccgcgtcgcttatggctgtatttagcctgaaatgcctgaatgcttatgataaataatactatttttatatctgcatatcaggaacaggcgctattatggacttgctcaaagaagatgacaagtcctttgcatccactcttatgccaagcgctcaaaaaacactcgtgaaagagagtccacatctattttagaaacatttgtgattctaaaaattaacactaaacatacaactaacctctaataagatttgtgcttgtcggaataattttagggcaatagattagagatagttttggtcgtatcttagacaataatgctcctcaaaaagggccaagtgtatgactcaacattatccatctaaatttgtcacaggtactgatgcccttgctgagcttttactcgctcaggctgaactggataaaagccataatctcaacactgcggggtttgttgctggatatcgcggctctcccttagcccgtttagatcaggcattatggcagcatggtaaagaacttgctcaatccaatatccgctttcaacctgctatcaacgaagatctcgccgccactgcacttatcggtactcaaaaagtcgaatccgatcctgatcggaatgttatcggcgtctttggcatgtggtacggcaaaggacctggagtggatcgctctggcgatgcgctcaggcatggcaacgcttatggctcttcaccacacgggggcgtacttgtaatcctcggtgatgaccacggttgtgtctcctcctccatgtcccatcaatctgatctcgttttaatggcttggagtatgccgattttgcatccagcatctgtttctgactatcacgatgtaggattatggggctgggcggcatcgcgcgcgagtggggcttgggtcgggtttaaagcaatcagtgaagttgtggaaagtagtgctatcagaaaaagcaaaccctttcctgaatataaaacacctgaaatcgattctggcccagatgggctgcattggcgttggccggatcttcccggcccacagattgagaaacgcttggcctataaacttaaagccgttgaagccttcgccagagctaatccgatcgatcaactccttgccccgtgcgcccatccgcgtgctctgctggtcaccgttggcaaagcgcatcgagatgtgctggaagccttacgtgccggaggcttaacgccttcccaacttgccaaacaaggggtggcttttgtccatgtccgcttagtctatcctctgtcaccgcttctcagcgatcttgcttcacaggtcactgatatttttgttattgaggagaagaacgctgttgtcgagatcctgctggcacgccatctggttaattcacagaaaaatattaagctgataggcaaacacaatcatcttggccagcaatttttacccgcagacattgagttacgtccttcattgattactcccctgctttctggatggctaaacaaactcgatttgtttctctcggttcctctggaatgggcaactaaaacaacaccacacgatcttacgcttcccaaacgcacaccttatttctgcgcagggtgtccccatagcacatcaacccgtttacctgaaggcagccaagcccaaattggtattgggtgtcatgtcatggcggcttggatggatcgtaatacgggatttggtcttgttcaaatgggaggggaaggtgccgactgggtcgggcattcaccttttattaaccgtccccatctctttcagaatttaggcgatgggacctatttccattccggccatttatccattcgccaatcaatagccgcaggcaatcacattacttataaattgctatttaatcaggctgtggccatgactggaggacagccactggatggtaatcttaccataccgcagattgtagccttaatgctggctgaaggggtcaaagaagtcgctattgttacggatgatattgataaatatcaggataaaaacctgctaaccgctaaggtgacgctttatcaacgtgattacctcgaagaggtgcagaaacgttttcgagaaatcgcgggggtaaccgtaattatctacgatcaggcctgtgccacagaactacgccgtaagagaaagcggggtctggagccgaaagcgacacgacgcgccgtgattaacgagttggtctgtgaggggtgtggtgactgtcaggtacaatcaaattgcctcgcagtgatcccggtcaaaacctcactggggactaaacgcaagatcgatcaacacgtctgcaactccgatctatcctgtctgaaagggttttgccccagctttgtcaccgtcgaaaatgccaatccacgccatgatctcagtaaaataatcccgcaaggcgatctagacaaattactccgtgaattaccccagccaatactgatcattagcgataacccttatgagatcctgctcgtcggcgtaggtggtacaggtatcgtcaccgcagggaatttactggcgattgcggccgaagcagataattattccgtcagtctactcaattttacgggttttgcacaaaaaggcggtgaagcaatcacccatgtccgactatgccatgatatgaataagctacatcaagtcagaattgaccgtgggcgcgctaatctcatcatcgcggctgatttagtggccgcaacgggacaaaattcactgacagtgatgtcaaaaagtgcaacgaaatgcgtcctcaatactcatgaaacgcaaatcggcactatgcttcgggctcccaccctgaatctggatcatcccaaaatgatgacgactcttcaccaacactgccaaacattaaattccattgatgccgaaataatggccgctgatctggtcggtgaccgaaaccaaacaaatatcgtattaatcggttatgcatggcagctcggtaagattccaatcacgctttctgctatcgaccatactattcaagcactgggcaatgccgcagacagtgcacgacgcgctttccatatcggtcgcattgctgctgtacagccagatatcctgaatgagcgcctgcacatcaagccgcaagaaagcattaagacgctggatgatcttattatgcatcgatatcaatttttggttgattaccagaatgaaggatatgcacagcgttatctcagtcgcgttgctcagattcaactggtcacgcaacaaattgatgcggaagaaattgccaaagcggtcgctgaaaatttatttaaactaatggcttataaggatgaatatgaagtcgcgcgcctctatgccaaaagcgactttttcgaaaatctccgctcacagtttgataatacggataacattcgctttcacttcagcctgccccttttcaatcgcaaagatccacgtacaggcgagcgaggaaaacgagaatatggcacatggatcatccctatcttccgcgttcttgccgcatgtaagccacttcgtggaactatgttcgatatcttcggctatcaggaagagcgcagacaggaaagaaatttactgctcgaatatgagcgattacttgattttctgatagaaaaactgaaccgcgataatttagcgatctgtcagcaactcgcggagctgcccgatcaagtccgtggcttcggtcatgttaagcaaaaagcgataaaaaacatgatggagcgtaaggaggcattactggaaaagctataaaaaaacagagtgatagcacagataaaaaatattttgggtacggtgaggttaagcggttgccatattattaatgaatgaacggctgcgaaaacatagaagccactgttggcgagtcttcatacagccgtttagcttaatccagatgatgcgtcattatcagtatgctttttttgacatgacatcaccctgttaattgaaggatatttctaccacattcattgcgcttgaatagcgagatcgtcaaataacagcgaatcctgaagccgtttacgcatggactttttggatgtcagcaacatactaacgtctcgctctaaacaagggaaaaatcggtcatgctgttcaatatcactcaaagatcgcgaggtgttgacgattgcacgggcacgcggttgccgaatagcttcatatcggcgtagcgcaacacggtagtcctcagtatttttaagcacgtaccccagcaccgcagcatcttctatagatattccagcaccttgaccgagactggttagcatcggatgagcggcatcaccgagaagagtcactcgtccctttgtccaatgttcagggaaggttctatctttggcgtctacagtgattatggattcactgtcagttgagttaatgatatcttgaacaagatccggccaacccgcataaaactcagctacatccctattcgtacctttccatcttttggcgtcatcattcgacatattcgcggttccccaccaatacacccagccatcaccgatatctacaatccccatacgcttccctctcccccaataatgggcaacgtagccgggtgtaattttgggatgggagtatttaactaaggcgagccagcaaatataaccggcttcctgaataatagattctgttccgatcgcgtcacgaattgcagaataaaacccatcagccccgacaataatgtctcccgatgaaacagtgccatcctcgaaattgatatggacagcatcactcgtttcgttatagccagttacgcgtttaccaaaactaatatccgcatcgccaagctgatccaacaacgctctctggaggttttcccttgatatgcaaatactcggagtgccttgctcatcagagatcttttgaacagggaggcgcttcaagagcaatcctgagctatgtcgaatctcaaagtttcgaacttcagcaccataattcttcaacccgaggtcgatatcaagcagcttcttcatcgccgaactggcgtttgacattaccgataaacccgatccagtcgctcgtaaactgtccgtcttctcaaagagacgcacagaccaaccaatttttttcaatgcgatcgcgcatgacaacccaccgatacccgtaccgacgatgagcgcagaaggttttctagacattagcattcacccctttcactttattaatttcagtaataattgccgacaccattggcccaacgaaaggttcttccataatagtcagatgatcgccatccacttcaatcaagttcactcggccagacgtcttgccaccccagccattcagaggatcatgatattcactacgaatagtattgtgcatctcttgcaatatctgaggaagaggctgctttgcgcgaataagcgtcacatcaagattcggacattgtgcgttgtattcagccgcggcttgccaattagcactatacacctcgaaaaggcgctgcatgactgcttttgtgctgccttccgggatcgctcctatctgggttgcatgatcagtgatgtactcgaatttctcttgcaagctttcgatataggaaggaacaacatgaacgggtaacgaagatcccttcgatgtccacagcaattcccagaagaaccaactaagcaaagcatcatcgctcgcctgaccttttgcctgtgagctcagagccatcgtatcaagaatcagaatattagagaccatttcccctgatcggattaactgattcgccatttcgaaggcgataaatccaccatacgaccagccaccaatcacataaggacccgtcggctgaattctcttgatcgcctcaatgtaaaaagcagcctgctcctcaatagtcgttattggtgacgagcccgcatccacacccgatgcttgaagagcataaagtggctgatcagatggcaggtacggaagcattcgcagatatgacagaatatttcctcccataggatgtaccaggaagagtggcctgctgttacctgctttgcgcagtggaacaagtgggtcaaatttgaactgaccaccaccgttttgaataagcatggcaagtttcgcaatggttggtgcgctaacaaatgctgaaagcggtacgttaatgccatacagtttctcaacaagaaccactatgcgcattgcagtcaaagaagtcgcaccacaatcaaaaatactctgctcaggggctatttcggggatcttcaggagctctgcggtcagctcgcaaagtctgctttcatactcgcctgctgggccacgataatttttttctgatacaagctgtatatccagtttccggagcatcgcatcatcacgcttgccactcggtgtcttgggaagctcgtttatccatgtaatgtgtgtcggcaccatatatgcgggtaactcagctccgataaactgcctcagttcctccagcgcgataccatcttccttacccaccagataggcgatcaagtatgaatccagatcgtcacgaggccgagcgacaaccgctacttcaacatttttcttaattttttcaaagaattcgagaatttttaactcgatttcagagagttctactctatagccacgaactttgaccagtgtatccttgcgaccaaggctgataatctcgccgcacgctgaacggatgccaatatcccccgtccggtaaaacatcccacctggtacgtcggcgtgtgcaataaactttttcttggtttcctccggcgaacggtaatatcccgatgccaaagcgtctccgaacacacagatttcgccaggaaccccatcgggaacgacatttgaactctcgtcaaggatcacaatgcctacacccgtgatcgggataccaatcggcggaagtgcagggaactggctgggatcactgctcatagtgtaacttgtcaccacatgagtctcggtcgggccatactggttttccaatatgccgccaggtagattatcgaccagcgtccgtatctctttggtgacacgcaactgctctccggacgagacaatcacccgcagtttcttcggaaagaattccagcataacggccgtctcagcgagttgttgcaaagcgatgtacggaaggaatatccgctcaacgcctttacgatcaagatgcctgaccaaagctaccggatctcgacgctccatctcgctaatcagatgcaacgtggcacctgatgagagggtggagagtatttcctggaaagaaacatcgaaactcaaaggcgaaaactggagtgtagaggtaaccttggcgccactacttattttattttgccagccaacaagattggtcaatcccctatgcagcatcgtcacgcctttaggcgtacccgttgagccggaagtaaatagaatgtaggccgcatcagcagaatctatcgtcgcatcgtctctttccgcagttgccgcgattgaatcatgctcaaggaaaagcatgcgcacacttgtgggcaactctgtaatagaatgatcggttacaactacggccggatttgctattttcaatatcagctcgattcggctggctgggtatgataagtcgattggaaggcaaatagcgccgatcctcagaatagccaagacagttgcaatttgttcaaacgacctcggtaatgcaattccaaccacatcctgtttatggacccctcgttcactcagcaaaaaagcaatctctgtcgccgcatcccatagctgctgatagctccactctacgttatcatacgtgatggcaactgcatccggatcacgttgaacgctatttcgaatcatggctggaagtgaaataaataccttatccgatgtcctttccacaaggcacccaacttcagtaatcgagtggctgagggatacgggtaattctggttgataagctattcgctctaacacacgattaaagagcctggaaaaaaccgccccttgttctctggcataaatgcttccattgagatccacccgaacactcgtacgttcgccatcaacatcgcgcattacgtttaccagaatatcgaaatttgtttcctccttcggatcaaaggcgactatttcaatacctgacttcgcagaaatatcctgcaatatatgaaaatgtacgtagttaaaagcggtctggacagagagcaattcattgtcagcttggatttggcttaagggaaaacaccgatgtttatgacttcttttttcatttcgatacagcccttcaacaacctgaagccaattccaattttttatatcaactctcaaaggaagtgtgttcaaaaatagccccagaatacgctccgagtgcttaatttccggccgtgtatgtgtcactacacccgtgacgatctcctctttaccactcattaacgcaatggtggtgcaatgagcggcaagataaaggtgctttatagggactcgaatagttcttgccagctgattaagtgcaacatcaagtacaggatctattaggaaacgataagaaaaaatacgtttcactggagcagttgaatatccagccaagcctattggcaatgtattcgtcgcgccagagaggtattctttccagtaattcttagactcacttgcttcaagggtttctatttcgttttggacaaaaattgacggattcggcaattcgtcttcagggtaaccgagattagcgccatcattcccctgagaataggacaaaagaagctcacgtatcaggtttgcaacgcttcctccatcaagaattgcatgatgaaagctgaaaactaagtcgatatagtttgattcactattagcaaatatcgctacgtggaaaagtggtcccgataagaacgaataattataccgtgaccacttatccatatgagcaagaactgtatgctcatactcaaccacatcaggcgttttaattgataaaacatcatcaattagaatctcgggtctgattagctgaaggggtaaatgatagtcactaaggttaaaaactgtgcgtaatgcggggtgcctacgaaccaatccttgcaaagcagatctgaatgcggcttcattccacgccgactttaaagtatatcggaatacatctttataagttctcgcaccttccatctcacgactatggaaaagcaaaccaagttgtaattgagatacggggtaagcatcatcgtatactgaactcagcatcttttggtcggttgcacttatgagagcaaaaggaggaagggcttctttcgggctactgagaacacgtgacacactttcgaggacatttcccaagctacatactgtcgtatactgcgccagatcggataagccaacgtcatacccgtgactttccagttctgatctcactttcaacatcaggatggaatcgccaccaagcgtatagaagtcgtcatctgcaccaatgtttgaccgaccgagtactttctcccatatcttggcaacaatcgtttcggattcatcaagttttactgtctgaggagatgctttatttccactgacctctctgagagcactggcgcgatcaaattttccattaggtgtcaggggaatgccccccagtcggacaaatcttgcaggaaccatgaaggaaggaagctgcttcccaagctttgcgcgaatatcacgctcattcaagtcttgtcggcctacatagactgcaatcaggtgttttccccgagcatcatcttcaacgataacctccgcgttcagcacctctggcaggttaagtaaggcgtttttgatttcaccaagctctatgcgattaccgcgtatcttcacttggccatccatccttccgaggtaaaggatggatccatcttcagcccaagccgcgagatcacccgttcggtaccagcgactgcaactgtcattctgatcgataataaaacgttctgccgtcagctcggggcgattcaaataacctcgcgctaattgcacaccgccaatctgtagttctccagatatacctataggctgcctgaccccatgcaatgaggctattctcactgaggtattgttgatcggaaaaccgattggtactgcgttgatatccgaatcctgttccagatttaattcatagtaggttacgtcaaccgttgcctccgtcgggccatataaattaattagccttggtggacgggtatcgcgaccgaaaagcttcctgtatttattcacgacagcaggggttaacgcttcaccacttgtaaataggcatttcagactgctaaccgataaaagagactgtctatcatcagtcaaagtttgcacatagggttcaaacattgacggcacaaaatgcgctaccgttaccccgagtgtagaaattgtctggatcaattctctgggatcgcgttgtgcaccttgtttcaggagtgcgacagaagctcccgtcatcgcccaccaaaaaagctcccacacagaaacgtcaaatgatatcgacgttttctggaggatcacatcgtcactggttaacggatgtatttcctgcatccactctaaacgattaaccactgagtgatgctcgacaatgacacccttggggcggccagtagaacctgatgtatagatcacatatgcgggttcatgaggctgagctttgcttctgtattgatgatgagaaggtagctcagttggcagagcgtccagacggaacaaacgaggatcatcagatttcataacgtggggtagattagaaatgactaacttggcgttgctgtcgttaagcatatattgaatacgatcttcgggatagtcgctatcaatgggtaaatatgccgccccagttttgaggacaccaaatattgcagccaacatctctggcgatcgctcgactgacaccgccacaatatccccctggccgattccccgtccttctaaagcagcggcaatggtggatgaccatgcatttaattgagaataagaaagcgatgtgccaatttgatctcgaagagcgatattttcaggaaattgttcagctttagcctcaaagagcgaaacaacggtttcattcacgctgtattgcttagttggcccattctcatactgtcgaagctgctccatttgcttagatgtcagcaggttgacttccgacacatgcttatcaacattattaccaaaattattgataagatggatgaatgtatctaagaatgcattcgctgagtcctcagtgtcaaatactgagctattcagacacacatctccccaaacatctgcattattgccataagtgtacagatgaatcgctatcgcatcctgagtatgcatgtgcgcaatattctgggttttttcttcaaatccagcaattgccccccattctggataacgcagataggacattgttacatcaaaaagttgacgagaggaacttgccagagccgaaataataccccctaacggaaccgattctttgtctttcagaaagacgataaaatctttgatctgcgagtaaattgctctgagtgtattttgaggtaatacctcgactttcacgggaagaatattagcccggtgactgactgacgtaatttctgcatcggttctgttaagaaacggcaccccaatgaaaaatttctcgcttccgtatgcatttgacagcagaactgccagagccgttgaaacagccaaaaaaggagtaaaaccattttcaataccatgagcaacttcgtgcgctgatattttgaatggtctgatatagctgggggatgtcgaaagagccgctccagattttggaaataacacgggatcagtatcagcgattttcacgacgacgtcgtggattgcctcatcaagtttactgccttgcagggttggatattttgtcgcgtaacgtttcacccctttaagttgttcatttagacctaaatgattatctgcataagcacctagtattttcttggacaacagattcagaccccaaccgtcagcaacgatgtgatgagcacgtaccattaatatagtagcttgatctgtttggcctatcgcaatctcgaccaagggtgaaacagaaagatcccaaatcttacgagaccattcattgaagaataaggcaaagtcgtcttcattcttgaattcatataactcggcacaaaccacaacaggagctttcttcagaaccagatgtccctcttgctcgtgaaaagacttgtgggaagcttgctccgactccagaacttgttcagcaacccccttcagatttacaagatcgatagacctgggtaacaattcactaagagccactgtgaactgatgacagtgcggatcatgtagctcctcaacccataaatccctttcgtacgaagtcggttctccaatatcggtagcaatactcatagcttgaactccatttagactaatgacattagctctacgaataacgacacaaaccgagtatttctgggctgaagctgtccccttgattgaaccaagccaaaccgctccatctcggctcttaatattcgaaaaaattatttcagatgacataatatgtcatctaacgacaatatgtcaccgcgtgacatattgtgtcaaatgacattttactgatagtatcattagttaactattacataagtgtccttttatgcgataatggaggctcaaacaccgatcacttattccagacaggaggaaacaggcgcgtgacagatagagaaaaagttggccgccgtgagcggaagaagcttatgctgagggatgccctaattaagacatcttacgaactttttgctattaagggatttgatgaaactcgagtagaagatatcactgaaaaagttgacgtttctacccgcactttttttcgatatttttcctcaaaggaagatgttgtccttgactaccaagaggcagaacacaaagactttattgccgcgctcatccgccgtccacctcatgaacccgcgttatcagcattacggcataccgctgtcgaaattatgagaaaatgtgaaggaggttcttatggctttaatacaaactgtttcatgacccttcaagacttgataaggaaccatcctttagttcgggcaaaaaatcttcagcgcggagaggatcggaaaccccctatcatttcattaatcgctcaacgtatgggaaccgaccctaaaatagatattagaccaggcatcttagccggcgttttagattatgcgcattgggctacatatgacgtttggaagcggaaaaaacactcttctatgcgttactcagatgttcttgatgaagtatttctcattatcgagaatggtctcaactttccagcaaacaatcagccggatatctagtgactttaccctagataaccgaaaggttcgggtaaacgcaggccgggggttattaacgaccgactaaaaagcgctggatgagaatggattttggtcattatcactggaacgtaaaaaggacctttcggtccttttttctgtggcttgcagactttcataaaaatctacaatcctgaatttggagcgggaaacgagactcgaactcgcgaccccaaccttggcaaggttgtgctctaccaactgagctattcccgcattgctgatgactactgtcagccttaatttctagatacgaacatcctacaaccatttgatttaaaggagttttatatatttacgtaccaagatgggcgccattatgaacttgtttggagaagatggcaagctctttgcacacaacccaataccaaacgttcaaaatacatgctaactgacgtgacgtggacattttacacccgttgttaccctcattttcctgccgcatagtagcctgatatgcataaacaaaccagacagtaccgacagttgactcccgagcaaagatatcagcttcaagccctgtataacaaaggctttccacaacatttccggtgcggaactgtcggccagtttggcgaccaccggataggggatcggcggggttgatgcgcccatcggagttttacacacatccggcaacaggccgacgatcagccattcaccggccgtccggacgatgtagttatcagccatcctttttctcctcttctggtggggccattttgagcaacggcgcatccgggttgatttcaaatcgcgcttccgccacccgaatgggcagcgcggttttcacattcagccgacaggtcagatgcagcgtcagcgcctcgctgtcgagcattaacgtatcgaggcgcatcggcacgggcaacatcctcccgtcgtgcagccgcagcaaaataaacggacgatgccccggcagggtgacatgcaggtgcccgccagtcggcatcgtaagtgccggcaagctggcggcggggcagccacggccggccgagaaagcccagcccctgcggctggcaggcgggtgtatcggcagataatgttcccgccagctgtttcgcaaaatgcggtgccgtgaacggtacctccggcgcgctaatgcggggggctgggcaacgggtaagtggtttggcgttggcataccacggcgtgataaatcccattcccagcggattggtttcacaggcggcgtgagcaaccggcgctttttctccgtcagggtgttgctggcgctgtgccgatgtcagccgatcgctttccttaagctgtgcaactgctttatcatccgcctgaattttgcattcgcccccaaaggcgtagcgataatccagcggcagtgttgaaaacggtttcgggtcggtcagttgccactgaccgccagcatcacgaataaattcccgttcaccggtcacggtcagggttttgtcgagcagggtctgcccctgtttgctttgcacatgcagccggaccggaaacgccgtgcagggtcggttatccggtgcatatgcggtgccgttaacaatcacgtcacaacgcggtttaaacggggccaggtcactctcctgcaacacctgtgaggcattcatctgcccgcggtattcatcctgtaaacacagcggcggcgcgggcagcagttcggccagacaatggccgcgacggtcaggcagcaactgataaccgattttcatcaccatcacacggtgctctgtatccgccacatccagcattgaatagttcatcactgcaaagggggtcaggttacgaaattccatcccggtgtatcctccttagttcaggtcgatgtctttgccggtgatttgtaccgggccactcgcctcgaacttaaactcggtgccaataagggtaattttgccgctgctgtccatgcgcagggtactggcaccgcattgcagctcaatcacatccccggccttgatggacagggtgttaccgacgataaccgacttatggacgcccacctgttcgctctggcttaaggcgacggccgtattcatgactccgccgacggtcagggtgtgagccgctcttaaaaaagaataaatctggaagatcatgctgatatttccgacttcttgttcatgtataaaaatcgatcattccaaataaattgtttcttctggcaacaaattgtaagccatatccaatttattcattttgaccaattcatgaatctgatgtgccctattcgtaatatcctcaatgttgataatccatttatttacataacgttccactgcttgattacgcagaccaatctgtatagttctctgttctaacttatttaaatgaatgtctcgttcaggatcccattgaataaccacatcactttgttgaacttcttttttccactcttcctgagaataaaacaaatcagggtcataatgactaatcaccccctgctgcaaaatttctctaaatccctcatgtgtgatatcaatagccaaaatacgttcttgaccactatctttcgttccccaaccagcacgatacatcatccataagaatgaaggcttaatccatgtcatacgcgtcatgctaaaagggggagaaacgaacgtgttatgtttaatcgcactgtcagcaatagtagcagaataagcctgatatactctaactgattgttgggtcgtgtattaaatagttagaatgctcactaaatatagttttcacgctcaatgaaagtgcctatcactttatcgtgcatttcttcagatttggaataaccgattgtttttctattcagcctttttattcgggtacgatgggtaaggttggttctctctatacgttgggtaaatatctttccagtaagatggacttcttcaggaagacaatcataaacggcataatcatccgtacagtaaaaccggatattaaagggtgacaagagtgccagtagtttttcccatgtttttctgctgtgatccccaaaagtatgtgccactatccgtttcatacgcggctcccaggcataccagagccagcgctgatttttctgactccccacaaacgactcctgctcatccacttcacagataagatgaatgtcatccccgtcaagaggaagcgtcgtcacgttccgggggttgagtttttaagcgttttcatcacagtagctgttgccaccttcaatacgcgggccgtgtcacggatgccgctgttattcatcgccatatcaatagtctgctctttgactcccggtttgcaagcttgataggtgtatgccaactgaaagactttactgcaggcatagcagcggtagcggggataacctctatgaccttttccctgtcctttgacatcttctgattggtgacaataacgacaatcaacttctactttagccatgttccaccacgaaataccggaagattatcataacaactaactatttaatacatgaccccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccgatcattccggcttttggattaatcatgtaattattttttgttaatattacactttctatttactaaaattcccatgaaaatttcatggtaattgtaatcaggaggactaattctttctaaaaaaagttttaatttattcatattttcaatataaatattaatttctgacttttcatagctaagatcacccaataaatcatcaaacccatgaaaatctctacctatatatcctcttttaccccaaaatgcttctccaagcatgcaaaagaagtcaagataattattgatgccttctaagcttagtgaggcattaagtattttattaggttttggtgggaaaatttgctgccagtataaacatgcggttaaccatagattttttgcttctatgcatttgttgtttttccagtagataaaatcatttcctttaacccactcttttaaaatagcaataatggtaagaggtggctcatcagaagtttttattacgaatgaaaacccttggctgtttgttagagtattttctttgtctattatatgaccattaaattcaaatgcacatatcccattgatataataggatatagtaatagtgtcttctttttttactttgacactactctgcatctttatttcttttgatcttaatagaatcaatccaaaatcatcgctttcatgattactcaggtgaaaaaagtcaatatcatcggctatagcgcattctacatcattaatatatatgcaatatttactgtggatcatagtattgccattctgttgaataatttaatgtttatcatttcattgacttgtgccctggatatttaccaccatcggggtaccaaggactcggaaatttatagactttttcgtaatcatgatttaatacatatccatatattttttgaccattcggtaatgtttgttctagtatgcgatggtgtgggtcaagcccttttcctgaatgaactacttgccattctttagctccgatccagaatttattcgtttttccttttctatcttctaggtttttttgaattccagtatctttatgtacccttggagtaccttttcctgtgattatctcttcatattctcccctaacgcttaggtactgggtttggtgaagataatttagtgaacttatcgcaatctttgcccgccaacccaaacggatctacccatcctgtgggattatgcacatacccgtagggattcactccccccgccagccctatcgggtccggtgtcaggtactgccccgtctcccgatcataataccgaaaacggttatagtataatccactttcctcatcttcatactgccccacaaaacgcaggttgcagctaacgtgataatccgcatcattggaggccagcacctgagatttctccgccctgccccacgtcgtcagccgctgtgcccacaccagccgccttcctcgttcagcatttcccggggcgtaccctgatgatcgctgacgatgtaatgcaatttaccccattcataacgcgccgacggcgtaagtttacccggttcgtacagccagcggatacgctgatcttcggcgggcgtgccatccgcatacaacggcgtttcctcaatcaactggtcgccgctccacaggtaatcctgccccatcatggtacggggtttcggcgtcatatccggcttgccgtccagccagcgctggagattcgcagcggccagtttaccgtcatggactttgagtttccgaatgcgccgcccgaacgcatcatactggtaatgccagcgcgagccgtccggagtttcacactgggtcagctggttcagtgcatcccagcggtagcgccacacttgtggccgaaaaccatcgcgctgtgcggtcttttctaccagccgcccgctgtcatcatagcggtagctgacatcaccgcgccggataacccgcccggcctgctggcactgggtcatttgcgtcacggcaccttgcgcgtccaaaaaataaagccggaagatcacagggatctttccggcttatattttctgagttaattatctataacaacattgaaattttcattttttttacaataagttaaaaaatcaatgcatgtattcttttctccattgagtgcgatgcaaccaaagccagtatcttcatgaggataaacacctatattgagggcagggtttatgtaaaaacaaacctgacctattacccccgcatgacacataataagttttgaaagatcgataaaatcattttttgtaaaactaaaacttaatgaatgtgctggtaataatgtttctccatacaaataattttcatagctttctgtcatcggaagtaataagtttttttctttgacgctatggtaaatttcttgatatctcgcaattgtctctatgtcatcttctttatcatcgtcaaacgaaagggcagtaatgattgtcggactagcatgttttccttcaaagaaatcagaaaataactcaatggattcatcaataaggtgataagagaaatcatgttttctttcgaaaaaaccaacccaatttacagatgaactgaatccactaaaattaaattcacttagtgaaaaattattatttatcaattttaatgatttttccatcactcatacctatagttattttatgtcttggtttaggttctgcttttccaataccaactttccactcaccctctttatcgctatgtgtagtattacttttactccatatctcatttgtattcttattcttataattaccaccttttattttggtaaaatcatctgggtgagaggttggtgttctaacaaaatctcctacatctgcactatttacttttttcttcggattgtctaagtgacattttgccagcccaaaggggtcaataaaattgaccggattatcaacatacccatacggattcagcccgcccaataggccaatgggatccggcgtcaggtactgcccagtttcccggtcataataccgaaaacgattgtagtataacccactttcttcgtcttcgtactgccccataaacctgaaatggcaccccacatgataatccgggtcatttgaggcaatgacctgcgacttctctgctttcccccacgtcgtcagccgctgtgcccacaccagcccgccttcctcgttcagcatttcccggggcgtaccctgatgatcgctgacgatgtaatgcaatttaccccgttcataacgcgccgacggcgtaagtttacccggttcgtacagccagcggatacgctgatcttcggcgggcgtgccatccgcatacaatggcgtttcctcaatcagctgatccccgctccacaggtaatcctgccccatcatggtacggggtttcggcgtcagatccggcttgccgtccagccagcgctgtaaattggctgccgccagttttccgtcgtgcaccttgagtttgcggatacgccgcccgaaagcatcgtactgatagtaccagcgggaaccgtccggagtttcacactgggtcagctggttcagtgcatcccagcggtagcgccacacttgtggccggaaaccatcgcgctgtacggtcttttctactagccgcccgctgtcatcatagcggtagctgacatcaccgcgccggataacccgcccggcctgctggctctgggtcattcgcgtcacggcaccttgcgcgtccaaaaaataaagccggaagatcacagggatctttccggcttattctttaaattctgtcaaattctatactgttaggtggaaaaccgtcaggaaatgacatgcacttgatctttctggataaaacaccttctaaaaaatcagtgaagttttcttgtctatattcaacttctggtgcccttgcagcaataatggctaccttccataattcactgtcatctgatgatacaacccaaaagatatagtcaccgttatcagtaacgcctatgggaagcaatccatcttttttaggataaagaataaacggatagtaatccggatcagattcaacaagagaattaaaatcctcaataatccattccttctgcctgaaaaaattcagatcatcatcttcgctaaatgggttaaatatagtgataaaatcggcaattctgcccgtgccatattgagtgataaaatcaatataatctttaggaaaagcgtgccgctcatctatcaacgaccattttctgttctgaccattttcatttggatggataggtaagggcaatatattatttaaactctcgatactcattatttacattcctggagggttaagaacagttacatactcatagaatccgcccgaaccttcagccttcattgtaataccagctggtattctggaagggtccttataaataggaacagaactcatttcgacaacttgtccttgttctaaggcttttcttattcgaccctcgattccactcatgaaaggagtattagcaggtcgttgttgaagggtgactaagttcctaagtaagcgtacggggaaccccacctagccaggataaatccattgattaaaatagtttcacctattctgatgatggaaaaaactcacatgagccaatccaggtttactcaagccgagtggcgggacctgtttgaacagcagaaaaaatccgaactgactgtcccgcagttttgccaaaaaatcggtgtgtcgacaacccggttctatcaccaccgccaacgcacctcccatccaccagaaaagccgtctgggctggcttcaccgtctgcttttattaaagtcagcaccgctcagaaaaaatccgcctcatccagcatactccccatcttatttgagacaccacatggcacactgcgttttcctgccggcacggataagcatgttatcattgcgattattcgggggctcgccgcatgaaaatgtttgtggatgtgccggaggtgtatttgtgccgctcatttatcgacttccgaaaatccatcaacgggctggcggtctgggtggagctggaaatgcaactgtctccgacgcaaaccgcgttattcctcttttgcaacaagaagcgggataaactcaaaatcctctactgggataaaaccgggtttgcgctctggtacaaacggctggagaacgcgaaattcaaatggcccaccgccgtcaacagtgcctccctgaccctgacagagcagcaactgcacgggttgttatcgggttatgatgtcatcgggcaccagcccttctccgtacaggattgccatgtcgcctgatcccttgatgatcatcaaaccaacgggcattaattacgctttttcgccggggatggcataaaatgtccccatgaaaattgatattgatgccctgcccaatgaccccgctgaactgaaacggctgctgattaagcagtcgcagcggctggcctttttggaagagcagttccgtttagcccaacaaaaacggtttggggcttcctcggaagcgttccccggccagggggagttgtttaacgaagcggaagaaattgcgctgccggctgaaacggccgccgcacaggaaaccctcatacctccccgccgtaagccgacacgcaaccccctgcccaaagatttaccgcgcgaaaccgtgttccatgatatcgccgaggaagaaaaacagtgtgtgtgctgtggcggcaggttgcatcagatgggggcagatcgcagtgaaaaactgttgttcattcccgctcaaatcagggtggttgagcatgtccgccccaaatacgcctgccgtgaatgtgaaaaatccggcattcagacgcctgtcaaacaagcctccttgccagcgatgcccatcaagaaaggcatggcgaccagcagcctgctcagccagcttatcaccaataaatatcagtatgggttaccgctgtaccgtcaggaaagtgtgttcaaacagtatggcattgacctcagccgccagacccagagtgactggatattaaaatccgcgcagttgtttacgccgttggtggccaggttcagggaaatgctgttgcaacaaccggttctccatgcggatgaaaccccggtgaaggtggtgacgtctgaaaaaacgacccattacatgtgggtctattgtgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccgctcaaaggcggtattccgtcacatgatactttccggcgctgtttcagtttattaaatccccgcctctttgaacgccatttttatcagtgggtttctcatgatgtttcttcagaaaagcgggcgatcattgcgattgatggtaaaagtttacgccattcgtttgacaagaaaattgaacaaagcccattacatgtggtaagtgcattctccgttgagaaagggcttagcttatgtcagtgtgctgtagacggaaaatcaaacgaaattaaggccatccccacattattatcgatgctttccttgaaaggccatctcgtgacgcttgatgcgatgggctgtcaacgcacgattgcccagcaattacgcgagagcggagccgattatattttgtcccttaaaggcaatcagggaaaaaccttttcggaagcggttaactattttcaacaacaacaggcaacacaaaaaccttatctgaaacctgaccatgatgaatttgaagatagccatgggcgtaccgtcagacgacgcggatgggttctaccgctgacaccagaaacaaaacacttaggctcctggccagatattcaggctcttctggtcacagaaacaatacggcaagaacaatattctgaaacagtcacctcttattttcgttattatttaagtagttgtcaggatgctcctgcctttcagttagcagccattcggaaacattgggctattgaaaatagcttacactgggtactggatgtcacttttcgggaagatgattcacggatgagagagcagatcgccacaagaatatttgcccaattacgtaaaatggcgctcaatatcgtcaaacgggataccaacagtaagttgagtttgagtgcccgaaggaaatcagccgggtgggataatggctacatggaagccctgttatttaatcaattttagcctaccaaaatttcatgcgtaacccctggcaggatatcagcgggattgccctgactgtgtcactgaattatgggatggtttggaggtggagacacaaaacgaagaaaccgggaagtgtgctcaaagagcaattctgacaatcacctgacttgacatcagaatcaattactgaaatcattactttcaacgcaaaaggtgagcacaaactgtgttcacctgacttcgtatagagtggctgtttttagtttattaacttacgcaaagtaatagattatattcattaacatttgcttaacagcacttatttctgactcacgtgttaagttattgatatcacttcaacaaacgagttttaaaattggtgcccggactcggaatcgaaccaaggacacggggattttcaatcccctgctctaccgactgagctatccgggctaacggggcgcattaaaccgtattcagataattccgtcaacgactttctgtataattttatctttatgctttcaaattgttcaagtggttataaatttaaacaataatggagaggatagtgcctctccattcattgatattgatgatcagctatcgacgatagcctttctgggtattattcactttcatcaaataacggcgcgactcagaagctggatgcttattggtcagcgtttcataaacatcaccaggtgccatggtattgatgatttgtgccgcttttttcttatcactggagaacactctcagtacactgccagcgccgccattgtaggcggtaataacggcatatcgacgtgaggttgcgttgttgatttcccctaaatagatattctgcaagatcgatagatatgcggtacctgcatcaatgttattttcaggatcgaagagataactgcggctaggctggccggatttcccttgcattttgaagacatcccgcccagcggtatgctgcatgacctgcattaatcccagtgcatcagaacgactgacagcataagggttaaagctggattcattttgcataatggcaaggatcagggattcatcaacgccatatttgatggcggctttgcgaaccatcggtaagtatttatgtgcccgtttatctaaatgattaggaaccaattgaatggtgacggtccaaatcatatgtagccctgattggcgtttttgtaatttattctggagaagataatttgcaaaatgacgtgcacgccactcccaacggattgcctcacctgcattatccaaaacctgcccataaagaaatggctctttgcttatctgaatgtcattgatgtcagaataaagatcaacagagccaggatcgtcgcccatcagcaaggtggtaataatcgccttacgtaaatgttcagagggttcaataggcgatagagtttcaattgtgatggttcccgcatcaaaattgatatggctacgagtttggtattgatctgtgtattttacgtaatctttagggcctgcgattaaaacttcttgtaagccccagatattttcaatgttatgggcaaattgccccattaagatatcaaaaccattcgtatcttttacgtatgcttcattgtattcaatatcttttttgctagagcaggaaatcaggagtggagtgagaagaatcagagccagcagtcttttcattttacaatgccgtcaggtattgggatgtcatcagtgttagagcccgataaagaggctcttgttttatattaatgcataataatattattaacttacctcattaattgggtgatttttatttgttgtgtcacccaatgacaggcgttataagattatttttccggcggtgtataaccgtcgattttaatatcatgaccttcaaacaaaaacttcaccatttcttgttcgagtagtttgcgatgttctgggtttatagtgttcaattttttttcattgatcagcatggtttgtttactcatccattgctgccacgcctctttagaaatctcattgaaaatgcgcttgcccagttctcctggatagagctgaaaatcttggccttcggcttctcgttgcaaaaaagtacaaaaaatagttctgctcataataaatcctcaaaataatagggcaaagtttatcccagctgctgcaaaagatattcaacgggagctgccaatccaatagttgctggctggcgtaagttataccaaagtcccttgctttcatccatgcaggaatcaaaagataaaatatcgattttaatcggtacaatatcgagatgaaaatggctgaatgtatgacgaaatgcgatcagttgatcaggtttgctgtgagaaataccggagtctttcaaccattgttccagtgaagtctgatccgtgaattgaggaaatgcaaataatcctccccaaatgcctgaaagtggacgttgctccaaccaaactgtgtcgccatactgcatcaataaaaaataggccgttttctcagggatgatttgttttggctttttccctggatagcttgcccaactatgattggcgtaggagatacagcctgtattgagtgggcagatttcacatttaggtttgctgcgggtgcagaccatcgcgcccaaatccatcatcgcctgattaaaatactcgacgccctgtttcggggtaacacgggtactgatatcccataactggttttctacttcttttttccccggccagccagcaatggcgtagcagcgagccagaacgcgcttcacgttgccatcgagaatcgggaagtgctttccctgagacagtgaaagaatggcacctgcggtagagcgaccaacgccgggcagggcaataacatcactaaaggtagtcgggaattgaccattgtgtatagcaacaatctgctgagccgctttgtgcaggttacgggcacgagcgtaataacccagccccgtccataaatgcaaaacctcatccaatggtgcggcggccagtgaggcaacattgggaaaacgtgaaataaaattctggaaatagggaatgacagtcgcgacctgtgtttgttgcagcatcacctctgaaagccagacgtgataggacgttttttccagctgccatggcagggtcttgcgaccatagcggtgataccattcaagtaccgcctgtgaaaattgctcggcttccatcattagaataattgtctttatagatgatcattgtttcgtgaacaggattgcaacatagtgtaacctcagtgtaaacccgaactttgtttcgaagcgctacgcaaatcagcattaaagttgtgcttatggacactgaacttgataaaatcagccacctttgcataattgcgctctctttaggcaaccctgtggtacataacgtcccagacgcctgagcaaatgcctttaaaactgataaaaagtaccatgataaataacgtaatttcaccggaatatgatgaaaatggcagggctttgcgccgtgtccgcagttttgtgcgtcggcagggtcggttaacgagtcgtcagcagcaagcacttgatgatatgtggccaaagatgggcatggattatcagccagaactgttcgatatgggcgaactctttggtcgtgaagcgcctgttgtactggagattggtttcggaatgggagcatctctggtgatgatggcaggccagaatccagagaaaaacttttttgggattgaagttcatgtgccgggagtaggtgcatgtctggcttccgcagaagatgaaaatctcagtaatctgcgtgtaatgtgtcatgatgccattgaagttttggaaaatatgctgccggaacagagtctggaaatggtgcagcttttcttccctgatccgtggcataaagcccgtcataacaaacgtcggattgtacagcctgagtttgctcaacttatcagaagtaagctgaaaatcggtggtgtcttccatatggcaaccgactggcagccgtatgctgaacatatgctgaaagtaatgagcggggcagaagggtattgcaacgtgtcggaaaatagtgattatgtaccacgtcctgattcacgtccggttacgaaatttgagatgcgcggtcagcgtttggggcatggcgtatgggatctaatgtttaagagggtaaaataatggctaaaaaccgtagtcgtcgtctgcgtaaaaaattgcatattgatgaatttcaggaactgggtttttccgtaaagtggaatttcccggccaatacaccagttgatatcgttgacaacacagttgatgcctttattgaagagctggttgaaccaaacggtctggcgctggatgccagcggctatttacagtgggaaggtttgctctgcctacagaaaatcggcaaatgtaccgaagaacaccgtcagttggtggagaaatggctgaaagatcgcggtatggaagacgttgccatctcagaattgtttgatgtgtggtgggattgatacgctattgcataaaaatagtgttttatacagaaataacgttgtatacaagggctcctttggggcccttgtttgtctggagaaaaagtggtgaaggtaaggttctctaattcgttattggcagatatcttagatgaagtacgccctttgattggccaaggaaaagtggcaggttacatacctgctttggcagaagttgcggtaaataatctggcgatggccatctgtacggttgatgggcaggtttttagagcgggagatgcggaaaagcgcttttccatacaatccatttccaaagtattgagcctgacactggcgatgacgcgctatcaagagcaggatatctggcagcgagtgggtacggaaccttcgggacagccgtttaattcattagtacagttggaactggaaaaaggtattccccgtaatccctttattaatgcaggtgcattggttatctgtgacatgttgcaatcaaggttaagtgcgcctaaacatagaatgctggagttcgttcgtagcctcaccgggcaaaaatacatttgctatgatgatatcgttgcccgttcagaaatggagcattccagtcgcaatgctgcaattgcttatttgatgaaatcgttcggtaattttgagaatgatgtgctcacggttctacaaacttatttccactattgtgccttgaaaatgaattgtgttgaactggctcagtgttttatctacttagcgaatcaaggccgtatgataggttccggacaacaaattttaagtcttcggcaaaccagacagattaatgcgctgatgttgacgtgtggtatgtatgatggttctggagagtttgctttcaggatcggaatgcctgggaaatccggtgttggcggaggaatagtctgtgttgtgccaggggaattcacggttgctgtatggtctcctgaactgaatagctccggtaactcactggcgggttgtgcggcattggaaaaattggctgagcgtatcgggcgctctattttttagttcaaaccttagtaaataacagcctaaccccttgtatctgtgggcagggtgtcgtcaggcaaaacaaatcaggagaacgtatgttacgcagaatcgcgattgctgcatcgttattatttgtcgctcaggtacaggcagattctgactgtcaggcgacaattcaggatgacattattgtcacgtcaaagtcagtccagattgttggagccagtgggaatctgagaattttgccagatggttctatgctccgtaacggtaaagcactgtcattgaattcagaacagcgtggtaaggctcagcgatatcagcaggctattcggcaggatctaccgtgggttaagaaagaaacactgagccatctgacaagtgcccgtcaagcgctggataaagttgtcgtcaatacaatgggaaaggagagtaatatccgtaaccgtttatcccaattggaatctggcctcaataagcaaattgacaaagtacttgaaactcgttctgatggcattgcattcaactctcaggccattaagaaggtggaatccgaagggcagaatcttattcagcagagtcttggtggtattttgcaggatagcattaatgaagtgagccgtaagaaaagtgagcagaatggtgatggcaaacagatgttgatgtcttttctcggtggattaggcgggatgcaaaatggttttgatgcagaatggaaaaaacaggaacaagagctggatcgctttaagggtgaagtttgcagtaaagccaaccaattggaacaactacgcaccagtctcatgaactccattaagtgaatcacaatatatcactaaaaataagaatcaatatgaaattgattcttatttaattgacatagtaatgttgccacttagaatgcgagtcacttattactaatatgcgtaattcaggtgtaacaatgaaaaaaatcctgccagttgttttagcttcgctgctttctgtcactagttattctgcattcagtcagccatcagtgttatttactcctaattccgtgatagtacaatctggtgatttcgtcacagtaaaacatttttccggtgaaacacaggttaaaaagaaccctgaacggatcgtcctgtttgattttgggatttacgattcactggtaaagctgggtttatctgatcgcgttatcgcattacctgtcggcaatgcccctgaatatgtgcgtggtaatatgtcagcaaatatgcagaatgcagggggaatgaaagaaccggatttagaaaaattggctggcatgaaaccggatctgattgtgattaccgggcgtcagggtaatttctatccatctctgtcaaaaattgccccaacagtgaatttagatactgacagtaaaaattatttgtcgtcagttgaaagtaacttaaagttattaggtgaactatttaacaagcagaatgcagttaagacccagattgaagatctggaaaaaacgattgccacagcgcaggagaaagctaaatattcaaatagtaaggtattggttcttttacataacgcaggtactttatatccgaataaccaagccattgtctatgatgtggtgaaaactcagcgcgctgaattaccgcttccaaccgataaagaaaaatcccgtgcggtaacagcagaaatgattgctaaagcaaatcctgatgctatttttatcatcgaccgcagcaaagcgattggtgcaggagaattgacaaaaaatcagtttgaaaatgatcaggtgaaatcaaccaatgcctataaaaatggtaagattgtttatctgcaatctgatctatggtatttgtctggcggtgggctggatagtttgacacagcaagtgaatgcggttgctgatgtattgtaattccataatttaatgattcgttattaaatcatccccaagaaatcaatactaaattctaatgagttggttggtattaatactgatattattaccatcaaaaataaacgtgatttaaagcaattcttgcaagcaaggcattcgccaataaaggctgcacctgatattttcaggtgcagtttatcctttaaagaaacagctctaacagtgaattcaggaataacttgccgtgtttggtgatctgccaatgcgtcgcgttttcagtgatataacctttagccagtgcttcatcaagttgtggacgaatggcactttccggtaatccggtaaaatcactgaaatcgtgtcgtggcatagcttccagcaagcgaaaacggttcatgaaaaattcaaatggacgatcttcattatccaattgattttgttgatctaaataacgtccctgcatataaccgcgcgggtgcttggttttgactgtacggagaatacggccatcttcaaacgaaatttttccatgtgcgccgcagccaatacctaagtaatcaccaaaacgccagtaattgagattatgctgacattggtaacccgctttggcataggccgaagtttcatattgctgatagcccgcagctgtcaataattgatgcccttgggagaagatatcccatagcgcatcatcgtccggtagaacgggcgggcgggaaccaaagctggtattaggttcaatcgtcaattgataccaagacagatgtggcggagaaagttcaatcgcctgacgtaaatcatccaatgcttcattcagtgtttggttgggcaacccgtgcattaaatccagattgaaactgcgtaaaccaaggtcggcagccaaatgtgctgcccgttttgcttcgtctgggccatggatgcgccctagacgaatcaacttatctgaaccaaagctctgtacgccgatggaaattcgattgacacctgctttctggtaagcgctgaaacggccagcttcaacagttcccggattggcttccatcgtgatttctgcctgcgaagagagtggcagtgacgcccgtactccgtcaagcaggcgttgcataccctcagcgctgagcaggctgggggttccgccgccgataaaaattgtcgatacttcacgatcttcaatcatcggcaagtcagcacgtaagtctgccagcaggtgctcaacatattcctgatgtggtacatctccctttaacgcgtgtgaattgaaatcacagtaagggcacttttgtacacaccagggaatatggatataaagacttagtggcggtaatttaagcattaagcatggcttccaacagcattttcaacgcttgtccacgatgtgaaactgcacttttttgttcgtgactcagctctgctgccgtacagccaaattctggcacataaaaaatcgggtcataaccaaaaccgccattgccagcgggttcatgggtaatgatgccagaccagcgaccgtggaaaatcagtggagtcggatcttctgcatggcgtagatagaccagtacacaattgaattgtgcctggcgcttttcatcaggaatatcacgcatcgcttccagcagcttttccagattatcccgatcggaagcatcaatacctgcgtagcgggcagaatagatgcccggtgcgccgcctaaggcattgactgatagccctgaatcatctgctattgcgggtaaccccgttattgctgctgcatggcgcgctttgatgatggcattttcaatgaaagtcagacctgtttcatcggctgaatcaacacccagctcggtttgagccacgatatctaagccaaagtcagtcagtaaatcagccaactcacgaactttgccagcattgcctgtggcgagaacaattttttgcattgcttttatccaattaatttatttatctaatcaaccgcttatcattgaaattaaccacgtcatgacattgtaacgtaggacattcagcgcgtagagaactaacatgacaatcatggcagaaaaatcaatgccacccatggcaggaatgatacgacggataggtgccatcaatggctcagtcaattgaatcaaaacgtagtcaaccggattgcgtccttgactgatccaacttaataatgcacgggcaatgacgagccagaatatgagttttccggctgcggtaagcagttcaatcattccgactaggaacaaaatcgcgagaggtatcacaaattgtcccgttgcgagccatgcaggtatcagcatcttaagaagaacgattagataggcaaacactatggatgctgtatcgataggaccaatggcgggaatgaccttgcgtaatgggcgtaccacaggttgggtgattttaacgataaattgtgcgaatggattataaaaatcacaacgtacccattgcatccagactcgaagcagtaaaaccgcaatatataaatctagaacggtaagaaagataaagtttaagaattgcatgtagcagccctgattaaatgacacttgattgaattaaaatagtttttccatttcctgcgctcggcggattgctgcctgcatggcgctggatacgatctcaggtagatggccttcataaaaaatgcgcagagcttcggcagttgtaccgcctttagatgttacctgctcgcgcagaatagcaaaaggaagatctgcctgtgactcagcaagtttagccgaacctgtagccgcttgcaggacaagttctctggcagtttggctatcgaatcccagacgttcagcttcttgctgcatggattccataaacaggaaaaagtaagccggcgcactgcctgcgacggcaataatattgttgatgccattctcatcattgacccagcagactttaccaacaccgcacatcagtgattcggtaaactggcgatcaggctgagtgacgtactcaggcgcaaataggccactgatcccttgccccacaagtgcgggcgtatttggcatgatgcggatgatattgaggttatcttgcaacagcgtgtaaaaacgggcaactggaatacctgcggcaatagagagtaccagtttatgactgaaatctatttgtgaacgcagtgaatcacaaacttcttccatcatttgaggttttactgccagaacaatgacatcggcttcctgggcataacgaatgttatcgttttcgctgttgatgccatactcttttgccagaacgtcacgacgggttgtatttggggagcagaccgtgatgaattcagcaggataacctgttctgaccagcccggcgataatggcatgagccatatttccagcgccaataaaggtgattttacgatttttcattaaatagtcccgcatattaatcagttgattttggccagttaatttagggttgagtattgtactgacgggcaccgaaaattgccgttccaatgcgcaccagtgtagagccgcaggagatagcagcttccatatcatccgtcatgcccattgaaagtgtatcaactcgtggatattgcgttttcaattcaataaatgcttgttccatttggtgaaatatcgccatctgacgttcaaaatcgctttctggtgcagggatcgccatcagcccacgtaataccagattgggtagcgcatttatggtctttgccagttccggcagtgctgtcagaataatgcccgatttgctgtcttcaccactgatattaatttgaatcaggatattaagtggcgccatgttttcagggcgttgctcacttaagcgttgagctattttcaatcggtctatggtatggcaccagtcaaaatgttctgccaccaagcgacttttattggactgcaaagggccgataaagtgccataccaaatcattatgattagcaaagtgttgaactttctcaaccccttctcgaacgtagttttcaccaaattcccgctgaccagtctctatggcttttgcgatagcgtccgcaggtttggttttactgactgcaagcagcgtaatttcttgtggatagcgtccgcacttttgagctgtaagggctatgcggttcctgacatcgtgaagattttgttcgatattgttcataagtgactcaggagattaaaaatgaatatggaaaaattggtggctcttagtgtaaagcataatgcttctgatctgcatctttgtgtcgggaaagttccggttttgcgcatcaatggtgtgctgtacccacagatgcaactggcagaaatgcagggtgataccctcattgcatggagtaggaaaatattgaccgaagaacaacagcagcagttacaggaatacggtcatgttgattttgtggtggaaatgccagataagcagcggttcagggggaatctgttttaccaacagtgtcatgtttcattggtattgaggttaatcgcggataaatgtcctactctggaacaattatatgcaccggacattatccaacgtctgattttgcaggagcaaagcgggttggtattagtaacaggcgcaacgggaagcggtaaatctactactttgtcggcgataatcaatgcgttcaataatcatggcaacaaacatatcattacgttggaagacccaatagaattcgttcatcaaagccgaaattgcctgatacagcaaagacaaatcagcagggatgtgccggattatcaaacggctttgaaaggtgcattacggcaagatcctgatgtgattttgctgggagaattgcgtgacaaagagacgatccgcttggcattgacagcggctgaaacaggacatctggttctgtcaacattacatacccgtggggcaattcaagcactagatcgtttggttgatgttttcagtgcagaagaaaagggctggatatgcagccaactggcaggaagtttaaaagcagttatttctcaacaactgcttcctgccagagaagggggaagagtagccatttatgaagttctggtcgtcaaccaagcggtcagccatttgatcagggaaggaaaaaatcatcaaatcgcgacattaatgcagacaggagctgcctacggtatgcaaactcatgagcaaagccgacaacaacgtgagttgttgggattgctggctgttgttccacaatgacacccacatttcattgtgagtactattattgtgaatattgttgctcaaaccagctttccagaatgacgacagcagaaacagaatcgactttgcctttatccagagccttataaccaccgtgatcgaacaggtgagagcgtgcttctatggtggtcaatcgctcatcgtgcagttcaacctgaacgccaaaacgcccgtgtagccgattggcaaatttacgcgcctgagcggtaacgagttgttctgtgccatccatatttagtggtaatccgacaatgatcaaatcgggttgccactctttgagaagtttttcaatgagttcccaactgggagaaccctctttagctttgaaagcactcaatgctctggctgtaccggttatctcttgtccgatagctgtaccaatgctgtgagtaccgaaatcgaatgcgattattgtacggtttttcatcaggcatgccctgcttgtggtgcgaggttgtaaatattgatcccgagcagtgaagccgcttcatgccagcgatcagcaacgggggtctcgaaaatgatagaggattctgcactgacggtcagccagctattttccatgatttcttgttctaactggcctttttcccagcttgaataccccagggtcattaaaacattttcgggctggcgtgttgtacctaatgcttccagcacgtctttggacgtggttatcatcgtttcatcagagatctggatacttgaactgaacccggattgcggagtgtgcaagataaagccatgttcttcagacagtgggccacctgccatcacaggtttatctaaattgatgctgtcgtctctgccttcgggagtgatatccaatttttctaggatgctttggatagaaatttgggctataggtttattgataactaaccccattgccccgttttgatcgtgttcgcagatataaactaccgaacggttgaaataaggatcagagagcgaaggcatggcaataagaaaatggtgctgtaggttcatgtgttttctgatagttattttggcaatgttagcgtgatttggctcacagtatgtgagccaacattataaatggcaaatgctgtccagcctgttatgcaggctgtttttccaatcgtttttcgatggcatccatcagcataccagtaatagaaattgctgggaatgcagcttctatttcacgtacacaggttgggctggtgacgttgatttcagtcaaacgatcgccaatgatgtcaagcccgacaaagattaaccctttctctttcaaaactggtgcaacagcacgggcaattgcccagtcactttctgacagagggcgggcttctccgcgtccacctgccgcaaggttaccacgggtctcgccctgtgcagggatgcgtgcaaggcaatagggtacaggctcgccatcaacaaccagaacacgtttatccccgtccttaatggccggcaagaaattttgcgccatacaataacggctgccatgttcggtcagcgtttcaataatgacaccgatattcgggtcatcttgttttaaacggaagatagacgcgcctcccataccgtccagtggcttaaagataacatcgccatgtttttgatggaactcacgtaaggtttttgcattgcgagtcaccagtgtatctggtgtcaactctgggaaccaggctgtgaacagtttttcgttgcagtcgcgcagactctgtggcttgttgacgatcaaactgcctttgtcttctgccctttccagaatataagtagcatagatgtactctgtatcaaaaggaggatctttgcgcatcagaatcacatgcaagttatcgagagcaatctcttgctcgctgccgaactgataccattgctgtaggttttcttcgaccgtgagcagacgggtacgggcgcgggcttccccttgatgtagatagagatcattcatctccatgtaatggatttcccacccacgtttctgcgcttccagcaacatggcaaaacttgtgtctttcttgattttgatggatgaaattggatccatcactatgccgagcttgatcattctttctccttaacccagatcaccgaaacgaacttgcaatgccgtaattgcggtgagtgccgtagtttctgtcctcaaaacgcgagggcctaacagaatatcagtaaattggtgatttgccgtcatttcgatctcttcagcggataatcccccttcagggccgattaacaggcgtattttttcgactggcagtggcagtgtgttgatactttggctggcacgaggatgcagatttaattttaggctaccatcgttttccgcgcaccatgcttcaagtgacatgaccgggcggatttctggaatacagttacgtccacattgctcacaggcagagataacaatttttttccattgctgtaattttttctctagcctttccgcatccagctttacaccacagcgttcagaaagtagtggagtaatggtattgacacccaattcaaccgatttttgaattgtgaattccatcttttcaccacgggacattacttgccccagatgcaggtttagtggtgattcatgatcggacagtttgccatcggtaatacgtactttgattgtctttttactggcttcaataagttctgcatcgaaaacctgattgctgccatcaaataactgtaatggctgtccattactcattctaagtacccggccaacatggttggcagcctcatcactcagatagatttccgtctctacggagagccgttcagggtgatagatgcggggaattcgcatatttcttctttccttcttttgtccggatgtttccggtatggcgcaatagccatatcacaaagttgattcatcgccatgataaatgagcgctgattgcgtgatcaagctatctcttaaaccatagaaagcacgatatgcacttgcgagccggctcgcatatttatttcataatgactgttttaattgattttttattgctaatccttttagtgataaattaatatccctcgtgttctgattacggtcagaaaaaatagataaggaatataatgacagggatgttattcatgagtgccatgttgaatgttttcatggatgataataaaggatggtttgaccaatatggatagtataatgattatggttttctgtagtgtattaatttttttatcaatcattgatattaaaacttatcaattaccagatgttatcactcagcctttattatgggttggccttatttttaatagcagtgagaatttagtatcgatcaagagtgcgatatatggtgttatatcagggtatctatttttatggttattaaataagttctgtcgatatatattaaagaaagagggaataggatatggtgatctgaaattaacggctgctattggtgcgtggctgggtatggaaatgatccccgtattgatgttgctgtcttcaatatctggactgttcggatttatgatagtttggtttaaaagaaaaacatatcctgattttattgcatttgggccttatatttgtttgtctgcgatagtgttgatggggcttagagtcagtaatatcgatatcatggggatttaatcgagagcaacttgcaggttttgtgtaaaacgttcattctctcactttatttattggaaaagagaatttctattatggtattaaagattacggcactactggaaaatcaggtttttgcgccctacaaaacggcgttgaccggtaaacccggactgagtttactgattcagaatcaagataccacaatcctgtttgacacagggccagatggcagctttattgataacgcaaagaaattaaatatcgacttatctgtggtctcaacggttgtgatatcacacggtcattttgatcattgcggtgggctaccttttttttctactgatgccaaagttatttgccatcctgatgttaaaaatgaaagatattatggttgggtgatcaccgacaacaaagcacttacattcaaaaaactatccaagcaagttgattacggaaaatttgatacttttttctcaaaggatgaaactcatattaatgatagtttcgtctattcaggagagattaaaaaagaagaaaacaaatgctatggcgttattgttggagaaaaagtcgaaggaaaatattctcctgattttgttaaagatgaaggtgttttaatttataaatctagacatgggttaattatttttatagggtgtgggcatcgtggtgttattgaaattataaaattttgtaagaagataacgggtattgatcaagtttatgcagttattggggggctacatttacgttatgcttcaccgtttaaactattgcctatcagaaaatacatcaaaaaagaaaatatacggcatgtttatgcttgccactgtagtggtatgtgggggaggttatggttacctaatgctaaaagtctttctactgggcagtcaattgagattgattaatgttcttctatttttagataaaaaatgatgctgttatattaatataacagcattgtctttaaagtttgttgcatgaataacgttattcatggagcacaaaggaaatatgccgataaatcctgtatggttatattttcaacttattgaggccacttcatttcacctttcaataccttggcactgagttcaaggctggattcatcagcaaggtttggatagtgtttcttcatagctgcaatcaacgcctctgaatctttggcttttggtaactctttttccagtgtggtcagatacttttgcgtaaatgtgactgattccagcgtcatcggtgcattacctacataatggccaggtacaatagtgtcaggtttcaggctcttgatgcgatctaatgtctgcatccagtgctggcgtgatactttggtttgagtatctgcaatccatacatggatattgccagaaatggtgacgccgccaacaacagcttttaatttaggcacccaaacgaaagtacgatctgcggctgggccatctaaaccttccacgatcagcttttcaccgtcaacggtgaaggtatttcctttcagtggttctggcacaataacctttttcggggcctgatcttgtagaatgccaccccaatatgccagtttaccgtctttggtttcattgatggttttgatggtttcaggtgaagcgatcactttggcttcagggaaggctgtcgtgatcacatcaagaccaaagtaaaaatcaggatcagactggctgatatagatcgttgtcagtttttttccggtttgctggatcatttttaccagctcttgggcatcactctttttaaattgcgcatcaatcaggacaacttcatggtcgccactgatgatttcagaagagacagggaatacaccagtttcacctggattgtagatatccaacttgagattagttgcttgagccagtgatgccactcccagagaaagggtcgccgccagagcgatatttaatgttgttttgcgagccattattgaattcctgtatcaaaatgtttatttgcttgaatggcacgtataataagttgcatatttcgatttaaaaaccgcaaaatctgcaattatttgttgcatatatcgatctaattacagcaggggataaacaggcagaatggataggatcacggcagcacaggtttttgtcacgattgtggagcaggggagtttggttgcagcggcggaacggcttgatatgtcacgggcaatggtgtcgcgttatctggctgaaatggagaaatgggcaggtgttcgtctactgcatcgtacgacacgtaaaatcagtctgacttcggcaggagaaaatgcttatcagcgcagtctgaaattgctggaattagcggagacaatgcccgttcagcaatcactggtatcacaaaccctgagagggttgctgagagtgagctgttctcaatcgctgggtactagcgcgttgtctgttgctattcctgaatttatgcgcatatatccacaaattgccgtcaacttgcaaattaacaacaaagttatcaacttgattgaagagcgtattgatttagcgattcgcattactaataatttggaaccgaatctgattgcccgtccattatccatttgtcattctgttgtttgtgcggctccttcttacttagatagaaaaattattccgcagaaacccactgatttagcctcacataactgcctgacatataatttttttggcaaaagtttgtggttgtttgaaaaacaacatgaacagtattcagttcctgtcagtggtacgcttagtgccaacgaatcaacagtactgatggaagcggctttacagggagcaggcataaccatgcagccttattattctgctgctccgcatttaatatccgggcagttggttgagttattgccggattatcaacctcaggcaatggggatctatggtatttataccagtcgtcagaatatgccggttactttacgggcattgttggattttctggtgggctggtttgctaatgcaccccattggcagcagttaatgttgaaaagctaatgccagttttagcggaaactggccggtctgttgtttcaaatgggtaatgaatatttcgacgggttccgagaatggccgatgtatgggtttgattaaactgaccgtgaatgggatgtctatactgaatggccggacgcaaatccccgcatttttatccagataatccaaggcagttaaaggattcacgacagacatgccgataccttcactgatcatggcacagattgacgccgcgctgtgtgtctccatgatcatattgcgattgacatgatgttcgctaaatatggtatcaatgagctgcctgtaactgtcggttatcgacaggctgataaatttttgctcatgaaaatcttctggcgtcagttgtgatttttgactgagtggatgattggcaggcaggacgcagacttcattcaaggtaatcaatgtttcttgctcagtgcctgcgggagtctgcaaatgttcggtcaaaccgatatcgtggcgctgtgctgaaagccattcctccaacagcggggattcttgcgggatgatggtcagcttcgcttccggatagcgttgaataaaactatggcaggcttttggcagtaaagattgggaaaacactggcaggcaggcgatagaaagctgcgcatgttcaaattgacgaatgctttctgccgcattaagtatcctttccagcccataataagaacgctggacttcttcaaataatcgcaatccctgtgctgtgggaaataaacgccctttgatccgatcaaataatttgaatttcagcaactgttcaaaacgcgccagttcacggctgacagtgggttgcgaagttttcaacaacaccgctgcgtcagtcaggtttttggtggtcattactgcgtgaaaaatctcaatgtgtcgccatgaacaagagtgcataatttcatctcttttatacggattgctatttcatcatggataatgctttatctacatcacatgattagtttgaaaaataatcaaaacgatatcataaataaatagactacagctaaatggatattttccttcctgccttattgctgtcaataatgaagcatctgctggtttggtgagaaatttcaatgacgatatcaactttgactggtttttcaggcgaaaaatttactccagagaatctgctgcgtttacccgttgattacggaacaccattatgggtttatgacagtgacattattatccgaaaaatcaatcgattaaagcggtttgatatcattcggtttgcacagaaagcctgctctaatacccatatcctgagtttgatgagagcacagggagtaaaagtggatgcggtgtcattgggggaaattgaacgggcactttatgctggatatcagcccggccgtgatcgatccgaaattgtgttcactgcggatttgattgatgaaataacacttaatcgagtgattgagttggatattccagtcaatgtcggctccattgatatgctggagcagattggtacacgtcagtcgggtcatcctatttggctacgcattaatccgggatttggtcatggtcatagtcagaaaaccaatacgggcggcgaaaacagcaagcacgggatctggtttcaggatttaccgctggcgattgagaaagtccgccaatatgggctgaaattggttggattacatatgcacattggttctggagtggattatcaacatcttgccaatgtatgtaacgctatggtggaacaagttatatcgtgcggtgaggacattcaggccatttcagcaggaggcggattatcaattccttataaaacgggtgatgaaatagtggatactgaacactattacagtctgtggcataaagctcgccagcgcattgaacggcacttggggcatcatgttgaactggaaattgagccaggccgttttctggtggctgaatcaggtattttgatggctgaagtgagggcagtaaaaccaatgggtagccgtcattatgtgctggtggatgcgggtttcaacgatttgatgcgcccaacgatgtatggaagctatcatcatatttcagttttatcggtgaatagccagcatattgatgaggctgtttcgcaggatgctgagttacatgaaacgttagttgcagggccgttatgtgaatcaggtgatgtgtttactcaatcagcaggaggcgatgttgtgccgcgtttgttgcctcgcgtttgtgtaggggattatttgattttccacgatacaggcgcttatggtgcatctatgtcttcaaattacaatagtcgccctttgatccccgaaattttgtttattgagggtgacgcccgtttgattcgacgtaggcaaacaatagaagaattgctggcattggaagcggtataaataaaatacggggaattttgtgtccccgtattctcgattacttatattgttcggtcaacatcaagcggctttagtctgacgctgactttcaggcttttttgctgaatgaggtacagcaaatgcatccggctcaaattcatcaacattgattgaacgcagccggctattttctgcacgtttcagaatatctgcttcttcttgggtgatcttgtgatccgccagtgcacgttcagctaactgatccagacgtgtaaagctcaggtttttgcctgcttcgcggcttaagcgtgcatgaatgggttctgcggcaatgatatcgtgcagagcttcttccaataacccatgaggattatgctcgcttggtgtcagatattgcccacgaccaatccggctgcgcgttgcggaaggtgtttgtaatatctgagccagtttatgatccagtttatcagacggtgcagtatgtgaacgacccaatgggaacaccatcactcgcattaaaccagcaaccaaacggttagggaaattgcgcagtaaatcgttcagggcctgctctgcctgatacagactatcttctaccgcccattgcaacaatggcagatcttctttctgacggccttcgtcttcatagcgtttcagggctgctgtagccaggaagatttgactcagaatatccccaagacgcgctgaaatgcgttcacggcgtttcagacttccccccaatacacccattgaaacatcagagagcagggcaaggttagcacttagacggttgatgtgctggtagtaacggcgagttgcatcgctgactggcgtacggctggttctgccattagtgatgccaagccacaggctgcgcagggtattgctggcaacatgacccaagtgaccaaacagggctttatcaaaggctttgacattgttattttctgctgcggctatttcagccagtacataaggatgacagcggatcgcaccctgaccaaagatgatcatgctacgagtcaggatattagcgccttctacggtaatagcaatgggggcaccctgataggcacgggcaaggaagttggatgggccaagacagatgcctttaccgccagcgatatccattgcatcaataatcgagcgttgccctctgtgggtacagtggtatttcacaatagcagacagaaccgcaggtttttcacccagcataatgccgcctgtgatcatagttgccgcagcatccatcagataagtattacctgcaatacgggccagtggttcttcgataccttccattttgccaatcggaagtttaaattggcgacgaatataagagtaagcaccgattgccatggcggcacttttcaatccacctgttgcgttggatggcagggtaataccacggccgaccgatagacattcaaccagcatacgccagccttgacccgccattttcggtccaccaatgatgtaatcgataggaacgaaaatatccttaccacgggttggcccattctggaatggaacattcagtgggaaatggcggttgccgatttcaacccccggggtattagtggggattaaggcacaggttatacccaatgactcggtattcccgatcaaatgttcaggatcatacaatttgaatgctaatcccaaaacagtcgcgataggagcaagggtgatatagcgcttattccagttcagacgcataccgagcacttgctcgccttgccattcacccatacagacgacgccagtatcgggaatcgctccggcatctgagcctgcttccgggctggtcaaggcaaagcaggggatttcttcaccacgggcaaggccgggaaggtaatgttttttctgctcatctgtaccatagtgctgtaataattcacccggccccagtgagtttggaaccccgacagtaatcgccagaataccagagacaccagacagtttttgcagtacttgtgattgggcataagctgaaaagtccaggccaccatattctttcttgatgatcatggcaaagaagcgattttccttcaggtatgtccagagttctggaggaagatcggctaactcatggctaatttggaaatcatttgccatacggcaggcttcttccacagggccatcaataaatgcttgttcttcagcagttaactgtggtttcggatagctgtgcagtttttgccaatcaggattaccacggaacagctcaccttcccaccaggttgttcctgcatcaatggcttctttctcgtggtagacatgctgggcatgactttacggaatgcttttaagccgggtgcagagaatagagatatacgcgttggtgtaaagacaagggggaacagaataatggcaagtggcaataacaaccagtagctccaaagacccgttatgcccatgacgagtgtataggcaacaagcagcaggctgctggcagacaggctgactttgcggtaacaaagcccgccaatcaagactaaaaacaaaataatgctgagagcggtcatagtaaaaactcctgttaatctcaggtgagttgtcagaggtctgacctgttgtggtgtccttctttttagatgaggaaaacgtatttatcaatatatttacatcttaattacaatctagctcacaaagtcattgtagtttgctgtgtgaaaatttcattgagatgtgatggcatcttctttcaggagagggaatccgttacactgatcggcagattttattaattcctaagaccgttcaggagtataagtcccatgtatcaagatctgatccgcagtgagttgtctgaagccgcagatacgctggctaaattccttaatgatgatgcaaatattgacgccatccaacaagcagccgttttgctggctgattcattcaaagcaggcggaaaagtactttcctgtgggaatgggggttcacactgtgatgccatgcattttgcggaagaactgaccggccgttaccgcgaaaatcgtccgggctatccgggtatcgcgatttccgatccgagccatttatcctgtgtgagcaatgattttggttacgattatgtattttctcgttatcttgaagcggtagggcagaaaggcgatgtactgttgggaatttcgacttcgggtaattccggcaacatcatcaaggcgattgaagcagcccgtgcgaaaggcatgaaagtcatcacgctgacaggtaaggatggcgggaaaatggcaggaacggcagatgttgaaattcgtgtgccgcatttcggttatgcagatcgcattcaggagatccacatcaaagtgatccatatcttgattcaactgattgagaaagaaatggtaaaagactgattgtgtagtttgtttagaggtaggcgatgtgcgaattacttggaatgagtgccaatgtgccaacagatatcgttttcagtctgagtgggctcattcagcgtggagggtatactggcccccacaaggatggatgggggatcaccttctatgaagggctgggataccggacattcaaagatcaccaatccagttatcattcacctgttgctcgctttgttcagagctatccgattaagtcagaagttattgtcgctcatatccgtcaggcaaaccgaggcaatgtttctctggtaaatacccatccgtttacccgtgaactatggggaaaatattggacttacgcccataatgggcaattgcagggataccgtaacctgaaaacaggcaattaccgaccggtcggtgagacagacagtgaatgggcattttgctggatactgcaacaattatcgctcaagtaccccaaacggccttccaactggcctgcggtatttcgctttattgcatcgctggcaggtgagctgaagaaaaaaggggttttcaatatgctgctgtcagatgggcagtttgtcatggcctattgctcgacccaattgcattggatcacccgtaaggcaccttttggcacggcgaaattgcttgatcaggatgttgaaattgattttcagcaacatacccatcctggtgatgtggtgtcagtgattgctacccagcctttaaccggtaatgaagattggcaacgtattgaaccgggtagctatgagttattttactttggtgaacgtgtagtctgagttgatttacttaagagtaacgaactttcggattttgtactcacaatatattgcccgtctattacgttgacagtggtaggtttgctatttttggcaaagtattcataggcgggctgtaattggatccaaaacgaataattatcgttattgcgataacgctgcatattctgttgcgtcatcctgaaagggtaaatatttattcagggcaatcgcatctaaaattcattgacaatggtttaatttcatgtcgttatgcagcttttaaatccatccttatgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgatctcactaatggcatcccctctcacgatacctttggtcgtgtctttgctgcacttgatgcgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctgagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcacctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagtcactggcaaatagaaacgcaactccattggtgtctggatattgcttttaatgaagatcagcagcggatgcgggaaggcaatgcagccgccaatatggcattactcaataaaatcgcgttgaatttactgcgcttagctcccaccaaagcgggaattaaagcacgccgtaaacgggctggttgggatggtgaatatctacttacagtactgggcaaagcgcatcaaatttagatgcgattgccttgaatatttattttgatttcatcctgtccgtaagatattgcactttccgcatatcggtagatttcatctatatagcgatcggtcatggcgtaacagccaatggatttacatcccccatgaatcattaaattattaccagaatagcctcggaatttatcaaattcattgggaaaacccaaattaatagcgcgataatagcggctattgggctttaattgtttaaggttaacatgataaaaaccttcggggcttttgaaatctcctgtcagtgtcttagggccaagccctccagagtaattacagataggataactttgagctaattggtaatggtctgtgttgtctttagtataaagttcaagcactttttcttctttgaatatttgaatgaaaatctcggccccaggttgtttcagcgggcgtcgttcattgggtgactggagccacgatggagtgctttgcgccagagcagaacaggacatatggaataacagcaacagtgagagataaaacgccgtttttttcataacagaaccgtataaaaggataataaatttaatgaaatatcggattgaaagttgccatatattgacaatgcgctgaatacaaatatagcagcgatgtttggcatcagtgaaatggtggagcggccaataaacgctctgttatcgggaaagatgaggctttagttcgtctttgtcgagtggttaacgatttggcagagaaattattcttatttgcttgagctgaatcactcgattagtcagacagcttgtgaggggagatgttagaattaccgtcggagaaaattaagagaaaattgtaacgattatcggagtgaataacttgagacatatgccgctcaaggcgtttttttattactgaagtcgctatattaccccaaggaataccatcgggtaatctgtagcatatgatttaactgataaacttgtgcaaatcttatgattaaaattaaaaaaggactcaacctcccaatagcaggagcgcctgcccaagttatagaagatggtccgacaattcgtcatgtcgctttattaggcgaagaatatgttggaatgcgtccttctatgctggttaaggaaggtgagcatgtcaaaaaagggcaaattctttttgaagataaaaagaatccaggggttatttttacgagtcccgctagcgggaaaattattaccatcgggcgtggagaacgccgtgtacttcaatctgttgtgattgaggtgagtggtgatgagcaagtcatgtttgatcgctatgatcgtacagaacttgctggcctgacacgtgaacaggtggagaataacctgctcatatctgggttgtggacggcattacgtacacgtcctttcagtcactctcctgctcccggttccacaccaaaggcaatcttcgttactgcaatagatactcagccattggctgccgatccattagtcgttattgcgacgcaggaagaggcttttgttgatggcctgaatattctgtcaatattgacagatggaaaagtccacgtctgccatggcgctggaaatattccaaatgcaggaaacaacactcaaattacttacaatcaatttgctggtccacatccggcaggtctggttggaactcacattcatttcattgaaccggttagcgccaagaaaagcgtatggcacttggggtatcaggatgttattgccattggtaagttattcacaaccggtgagctttacactgatcgagttgtatctctggcgggtccacaagttaaatccccccgcttagtacgtagccgtctgggagctgatttgcaagagctgactcaagatcagctgaaagaaggtgaaaatcgtattgtttctggctctgtactgtgtggtaccaaatcagatggagttcgtcattatcttggtcgtttccatactttggtttctgttcttgctgaaggccgtgaaaaagaattatttggctggattgcaccaggcgttaataagttctcgattacccgtaccacgattggtcatttcctgaaaaataaacgttttgccttctcaaccagcacgaatggtggggaacgctctatggtgccaatcggcaactatgagcgagtgatgccactggacatcatggcaacgcatttgttgcgcgacttgcttgcaggcgatagcgacagtgcccaggcattaggttgtctggagctggatgaagaagatttagcattgtgtacctatgtttgccctggcaaatatgagtacggtccggtactgcgtgatgtgctgactaagattgagcaggaagggtaattcatgggcctgaaaaatttatttgaaaaagtagagcatcactttgaggccggtggcaaactggaaaaatattatcctctgtatgaggcagtttccaccgtcttctatactccgggaacagtaacgcgagggcgtgcccacgtccgtgatgccatcgatctcaaacgcatgatgattttggtctggttatctgtttttccggcaatgttctggggaatgtataacgtcgggaatcaggcaatacctgctctgactcatttatacagcggagaagcgctacagcaggttttagcttctgattggcattacgtggttgcccagtatcttggtgcatcactgacgccggatgctggctgggacagtaagatgttgctgggtgcaacctatttcctgccaatttatgctgtagtgttcgcggttggtggtttctgggaaattctgtttgccatgatccgcagacatgaaatcaacgaaggtttctttgtcagttccatcctgtttgcgctgattgttcctccgacattgccattatggcaggctgctctggggatcactttcggtgtggtgattgcgaaggaaatatttggtggtacaggtcgtaacttccttaacccggcattggctggtcgtgccttcttgttcttcgcttaccctgcccagatttcaggtgatctagcctggacggcagctgatggtttttccggtgcgactccattgtcccagtgggcaaatgcaggtagtcacggtttaatgaataccattaccagccagcctgtcacatggatggatgctttcattggtaacatcccagggtcaattggtgaagtttccacactgatgattttcatcggtggagccatcattctgtttacccgcattgcttcatggcgcattgttgccggcgtgatggtcggaatgatagccatgtcttatctgttcaatgcaattggttcaagcactaacccaatgttctctatgccgtggtactggcatatggttctgggtggcttcgctttcggcatgatctttatggctactgatcctgtatccgctgcattcacggataaaggaaaatgggcatacggcattctgattggtgtcatgtgtattcttatcagagtcgtaaacccagcatacccggaagggatgatgttggcgatcctgttcgctaacctgttcgcgccactgttcgattatctggtcgtgcaggccaatattaagcggagaaaagcccgtggctaatgagaaaccaaaaaataatgacagcattggcagaacattcctcgttgtttttgtgctttgccttgtatgttcgattgtggttgcaggggcagccgtaggcttgaaagcgcagcagcaggaacagaaactgctggataagcagcgtaatattctggatgtcgccggtctattgaaacccaatatgacgacagcggaaatcaaagaaacctatagcagccgtattcaacctgaattgcttgatttgaaaacggccacgcttgaaaaaggcgatggtaaatttgacctgaaaaatgccctgcgtagtgatgaaaccagcatggctctgccatcagaacaggatctggcaagaatccaccgtcgcgccaatatggcagaaatctatctggtgaaagatggtcaaggcaaaactaccgagctggtgctgccggtatatggttctggcctgtggtcaatgatgtatgcatttatttctattgatgtggatggcgtaacatctcgcggcattacttactattctcatggtgaaacaccgggattggggggggaagtggataacccgcaatggcgcaagcagtgggtgggtaaaaaactctataactcacaaggtgttccggcgattaaggtcgttcgtggtggtgctggcgataacccttatggtgtagatggtttgtctggagcgactctgacctccaatggtgttcagcatatgtttgatttctggctgggtgataacggttttggcccattcctgaaaaaagtacgtgagggagccttgaaagatggctgatagtaaagaggtaaaacgcgtccttcttgggccgctgtttgataataacccaattgctttgcaggttctgggagtgtgttcggcactggctgtcaccaccaagctggaaactgcgctggtgatgacgattgctgtgacattggtgacagcattttctagctttttcatttcattgattcgtaattacattcccggcagtgtgcgaatcattgtacagatggcgattattgcatcgttggttatcgtggtagaccagattttgcaggcctatgcctatgaaatctccaaacagttatctgtgtttgttggtctgatcatcaccaattgtattgtgatgggacgcgctgaagcctatgccatgaaatctccgcctgttgaaagtttcatggatggtatcggcaacggcttgggatacggtgtcattctgttgctggtgggttttttacgtgaactgtttggttcaggaaaactgctcggcatgacggtgctggaatctgtcaagaatgatggctggtatcagccgaacggtttgtttctgttggcaccgagcgcattcttcatcattggtatgctgatttggggtctgcggactctgaaacctgcacaggttgagaaggagtaacagacaacatggaacattatattagtttgtttgtccgcgccgtctttattgagaatatggcgttagctttctttcttggtatgtgtacgtttttggcggtgtcaaaaaatgtgaagacagcttttggtctgggcgttgctgtaactgttgtgttgggaatttccgttcctgccaacaaccttgtctacaatctggtactccgtgatggagccttgatggatggggttgacctgagcttcctgaacttcattacctttatcggggtgattgctgcactggtacagattctggaaatgatcctcgatcgttatgtgcctgcactgtataacgcactggggattttcttgccgttgattaccgtgaactgtgcgattttcggtggtgtttctttcatggcacagcgtgactataacttcagcgaatccgttgtttatggtttcggttcaggtatgggctggatgctggcgattgttctgatggccgcgatccgtgaaaagatgaaatatgcggatgttccagcaggtctgaaaggattggggatcacctttgtcactaccggattgatggcattgggctttatgtccttctccggcgtgcagctctaaaggcgagaagaattcatggatataatcattctaggcgtagtaatgtttaccctgattgtgttggcgctgacggctatgattttgtttgcaaaatcaaagttagtgaacaccgggaatattaaaattgaagtcaatggcgatgaggaaaaaagctttacggctcctgctggcgacaaattgttgaacatgctttccaatcagggggtgtttgtttcctctgcttgtggcggcggtggctcctgtggccagtgccgtgtgaaaattaaagaaggcggtggtgacatcctgccgactgagctttctcatattaataaacgtgaagcaaaagaaggttgtcgtctggcatgtcaggttaacgttaagcaagacctgaaaattgaattgccagaagagattttcggcgtcaaaaaatgggaatgtgaagttatctctaacgataataaggcaacgttcattaaagaattgaagctgaaaattcctgacggagaagtggtgccgttccgggcgggtggttacattcagattgaatgtcctccacatgtggcccgttatgcggattatgatgtaccagaggaataccgtgaagattgggataaattcaatctgtttcgttatgtttctgaggtaaaagaaccgactgttcgtgcgtattcaatggctaactatccagaagagcacggtatcatcatgctgaacgtgcgtatcgctacgccgccgccaagaaacccagacgttacaccgggtattatgtcctcttacatctggtcattgaaagccggtgataaagtgacaatttccggtccatttggtgagttctttgcaaaagataccaaagcggagatggtcttcatcggtgggggcgcaggtatggcaccaatgcgttctcatatctttgatcagctcagtcgtctgaactccaaacgtaagatcagcttctggtatggtgcgcgttccaaacgtgaaatgttctataccgaagatttcgaccagcttgcggcaaagaacgacaattttaactggcatgtggccctgtctgacgccttacctgaagataactgggatggttacactggctttattcacaatgtcctgtttgagaactatctgaaagatcatcctgcaccagaagattgtgagttctacatgtgtgggcctccggtcatgaatgctgcggtcattaagatgttgaaagaccttggcgtggaagacgaaaacatcatgctggatgatttcggtggttgatggttgtaacacgttgatttaacgacaagcgcccacaccttgtgggcgctgacgattcagaaagagtaagttatgctgagtaaaaaaattatccactggggtgtgttgatgtttacggttttgctgctgtcagcctgtggtggccctgaacagcaaaatctgagcgggcaaacgatggggacttattactccgtcaaatatgttgctgactcatcgataccttcccctgaaaacctgcaaaaagagattgatcggctgctggaagaagtgaatgaccagatgtccacttatcggccaaattctgaattaagtcgttttaatcaaagccgtgaggttaacacaccttttctggtatccgccgctacggccaaagtggtcaaggaagccattcgaatcaatcaactgacggatggtgctttggatgtgacagtagggccattggtgaatctgtgggggtttgggccggaagggcgaattaccaaggcgccgacggatgaagaactggttatgcgtcgtgcgtggacgggtatcgataagttgtctgttgaaggtaatagcttgattaaatctattcctgaactttacgtcgatctttcctccatagccaaaggctatggagttgatgttgtggctgaatatctggcctcccagaacatcaaaaattttatggttgatattggcggggaagtacgcacactgggtaacaatggcaaaggcgctccgtggcggattgctatcgaaaaaccatcggatagtggcattgaacagagagctcaagaaattattgagccggatcgtatgtctattgcaacatcgggtgattaccgcaactatttcgaacagaatggggtgcgctattctcacaccattaatcccaaaacaagcaggcctatcactcataatctggtttcaatcacggttattgccccgacatgcatgagtgcagatggcttttctacgggactggatgtattggggccagataagggaatggaagtggcagagaagctgaagattcccgtctttatggttgtcaaaactcaagatggctttgaagagcgctatagttcagcctttaagccatacatacaacagaagaaatgaggaggaaaggttatggaagtctttattgcagcctttatctttttcttgttggcttttgcaggaatggcactgggctacatttttaagcgtaaaagtattcagggaagttgtggtggtttggggagtattggtgtggagaaagtttgtgattgcccagaaccctgcgatacccgtaaaaaacgcctggcaagagaagctgctcgtcatgagaagctggaaaaaaaccgaattctttgaggttttttttgtggttaaaaaattttcagctaaaaaatgcgacccgctgccagatacacagcgggtttttgttggttgttcagatgatgttgagagagtgacatttgctgtgagcctgctgtaagtaatttttcacggagctcattgaaacatctaaattctttgcgacttctttatagcacataccttgaagttgcgtgagaagaaatgcccgtctggcttttttgggcaactcatcaagggtcttatctattctttccaactgttctagcagtacaagccgatattctggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacctgaatttgtgccataccagccattaatcaatatatagatttggctgatttagttcagccggactgtctcgcgctaccgaaactcttatagcgataggatccagttgttcagaataaccgaatatgtgaaacttacatcagacaaccatcggtaaatattataaggacttgatatgtcacaattcgaaaaattaccattcggagataaaacacctctaatacttatttttggtgggatatttttactcgcagtttcaattttaaagtggatgacatctgatattgaagtggactggctgtataactcaattgaaagcttgctggctatttaccttgtcaaccttggaatcagactgcgtaaaaagtatcgaaacaataacgagtgaatttgaaccttcccgtattaccagagggttatgaaaccattcaaattcatctttcatggaggtgatctctttttcgctgaaaatcagattaacacattgatttatctagcatgcaggggtgttctctaaccccgatcgaggtgctgctcacatcaccataaaaacaatataagatattgattttatggtgatataatgtactgtccgaccctgatcaattatccggtatttccggtgagtggaacttgtgactatacccttataaccgccaacatttctttaacttcttcatctataccaacttcaataaagccgaaactggcataaaaatttttcgcaacaagattatttgggtcataacagatttctatttcttccaattgctctgtccgtctgatttcctcaatagctagtgataacgctttgcgcccaatacctttattttgatggcttttatctaccataaaacgccaaatagttgttttttgtccggtatcagaaggtacccacataaaaaaaccaacaggtgtaccatccaaataaatcgcgcgagtttcatatgatggaaaaaacttggattgagcgagagaaaacacattttcagcaatatattctagctgttcatcagttacagatagatcgcagacagcttcataattgtccttatttatatcaactaacgcaattaacataccacactccaaatggctacatatcaataacactaggatactacacatgtaactacaaccaaagggaatggcaattcttatctgttttttttgcaataaaaagccccgcgagtgcgaggccttggaattcaagatacaaattataattatatccaattgacataaagacgcttggttacacctgtatgtttcaatatggcacccaatttttttgcatcattatttttatatgtattgtcgattacatgtccgtattctggtttagttgtaatatctaagcttttacctagattataagtcataccatcaaccgttatatggagttctttagtttgaaagaaatttatcaagttatggaaactttcttgactagtatcagaatacgcgagccaaagaatcactccatcgctatgctctctatttacatgccaataaaatgatgtggtttccacaatgcctgttttattttgaatgactttcaaatcaccaaaagatttcgaccactcctgctcatcccatttgtacccatcttttacatatccccaagcaacatgaccttctgatccttgtaatgttgcattcgcggttcctataaaaagatcaaaagacaacatgaagtccatttttacccaatcacaggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattatcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccaatcacaagccatcatatcttcttgtgcgggctgccactgttcaaaattattgtgtatacgcttcttaataacataaggaagattatcaccttcccctgattcaggaacaagtcctatgtattcattggggtaatcccaatcattgcgatacataaggtttcctaaatacaattgaattatcgcccaaggatatgaaccaacgggtgcaactacatcgtgatttttgtattgatcagggttgataaagcaattttgattagcactcgttttctctggcttattaatttcagacataaatccctcactttattattcgttaaaggtcatttcatcctactgctaaattgccagtcaatattacttaaggtgggtttttatatcaattgaataccgtatagcaaaattaatacgcatttaaatagggttgcgcattataaaatctgtctattagtcgagtacgtgattcagggagctgtcaatttgaagtttgctgctgattacaaataccctttattgaatacagggcagtaaaaaacccacctattaagtgggttaatttattacttacaattctggcaaaatatcagaattaattaaaatatggctgatttcggacacttttgcaagttttatagatcatggtctgatttttgtttaattcttaatctgatgatatcttggagtgcttctctatccatgttttcgcataactccaccaaggctatccaatgtgccgcataattatttttccaattgtataaactcaccccagtcaagctggccaattctgatctggtataagataagaaattctctgaacgacaccccttggcacgttgctgaacggccaaccataccaatcctttcaatctcgtgctgactttgattgataaccgacggtttgtttgccctgccagaaagcctccccagagatattcgcatatttcaacctgatagcgataatccagggaatgtgcataacagtacagtacccatgccagtttgggtttatccatggccagtactgcccgccgccacgagctccccctgtatgttatcgggttaataggcggtttgggctgttttctcatgcgggtttcaagacaaaaaaccggatcggtatcctgtacgacccagtgatttcccaccctaatacgggctttattgcgctaattcaattgtatttaggaaaccttatgtatcgcaattatagtgatctgtacatgtcagtggagagtcttcaaatgccgccaattgccccttggtttcaccggcaatatcaaacaatgcggggataatctgcgtgcgtacgtattgcaagtcatgcgaataccatttagtcattatttgattgcccctattcccagcgatctgtccaaaaaacgaaataataaatccacctggctaccgtgtttttcttcccatgccagcctgtcccgatgcaggtcgtcatgacattcccggcaaagtggcagacaaaacaaatcatgcgccttagtacccatcccgccctgcccatgaccgataatgtggtggggatcatcggcaggacgttgacaggccgcacagggctgggatttcacccatttcagccattgggtattgcgccaccgttgtaattttggcaaacgcataaagctggcgggcggttcagcgtcaacctctgccgtcagcacatttttaacctgctccacacgctcattaacaatgtcctgtgaggtcaggggttcccatcggatatcatgttcgctggtggtacttccaattttctctccgtggtcatctgcccgctgcagggcgcgatgactgataaatgatggcagcaaatccgccacccgatgaatgaccgcccagctaaataattctggccatgtcacctgatgatgagcaggcaaccggaaatcactgatgacgttatgcaatacccactgatacaggttttgttccgctgcgttttgtatacgatcagagccgtcccgacattggttatcatgatgccagcatgttctgacggcgctgttattatatacagttattgtcaataaattatgatggtaattttcctcatctgccgcctggcagaatgaaatcgtctgggcgatgtaatgcttcatcccttccaaaccgccagcgactttaatgacccgctcatgctgaaaaaaagggtacaaacgcttatcggaagccagccattgcccttctgttacttgccctgatggagcagaccggagcacagcaggctcaggcgtgagcaacatcctgccataaaacccatccaggagatggcgacccggcttaaagaccaccagccccagatcacggacaatgtgcggggtcagtaaataattcatgccatgtaccccactttgtattccgcccacaaacccgccacccagcgaattccctttgtggtaaagcgtgattgagtgaacgcatgagcattagtgatatttgtgcccgtcttcacttcaaaccgttttgcatcgatgtggttctggtagggcagcatcgtgccattcaatcgatacatgatccgcctgtccagcaggaacccgcgaaactccggttcttttgcctcaatcagcttgcaaacctgccgaaatgtcattgatccacgcgcatccacataccgatccacaaacgccacttttggggctgcatcggctaattgtgattccagcgcctgattgtgctcggccaaatctgcagctaaccgcaatgcgtcaggcagcgtttgggggatatgagaaatttggtgctgttccagtgcctgccagcaatccaccagccgggcagtaaactcaggggataactgtgcaacaatcacatagctgtcacgcttgcctatccggtattcataagtggtttgattctggtgatttttgacttccaccattggtgggagttgaataacagcccgttctgccagccgttcgacggttcttttcactgaatcatgtcgggactcaaccagatcagcaatctccctgctcgacatggttaatccgtatgccattaaacttgccatcaaatcacgcccttaccctgtccgcgtttcacccgtttcctgagatcttgatagtggatttcaaaattgaaatacggccaatcacgctgactctgacggataattttcagcaatatctgaccctcacaccagtgaccccgtaactgcctcagcgaccacctgcggcgcaactgataagccatcaccagcagagggaaaatattcacgccatagaccattttgctgcgctggaacattatgcagtccccccattctgctcagagcttccaccaacaacccgaaatcccgatagcaactcgtctttcgcaatctgttctgcggcctgcttccagatcccacgccaagcagccagtccaggcacttcattcatgcgacccactcccgctttacgtgccagttgtgccgcccgttcctgaatacggtttgccggtgtccagcctgttgaaaatagctgtcggaatgttgcgtcacgctccacggtatcaatgacaacgtcggcttccccggctttcagccagcgaccgttaacacaggcaggacgctctgctttgtgccatttgcacgccttgtcaaaatattccgcgcaattttccgggctaaacagggtttttggacgcaggtaatcccgcattttgccgtcgttcgcccacttggcaatcaagtaatctgtgatcagtatcaaatcttccgttgcgtaaccttcacttaaacgtgcacggatgtagcccatactggtttttccgtcacggtagttggaatcagtggcctgattgaagtagttcaatacctgatgagcgggatcgttaggttcctcgggaatgtcattttctgcgatatccagcgcgaacgtcatattttatgtgatgggcgggaattgaatattgcgccggatattgtctgcgattttcgctcgttgccatttgccagtaacacatttcagttggttgtgttcgacccacctcatctggaacgagcaggtgaaaacggttggcagcggaaaaagtactccgaaagaccgaagaatttgaacgatattctaacaacggagctgaacaacattatttttgatgcgacacgggaaggaaaggcgacacttgcaggagtggcgaaagtaattttggagaacagttatcagaaaggagaaaagcaatgagaatgaacacagcgtttttgttaatggcagagtttgaaacctcgcaaattccgctgtcaactatagccgagaaataccttgaactaaccccagcgacagcagagcgtaaagctattgaaggcaagttaaaatttccgacatacagaatgaatgacagccagaaatcaccgcgaattgttcatgtgcacgatcttgctgagtatatcgataagcaaagggagttggcagcaaaagaagtggaaagaatgcagtttaaaaaaaagtaaattgattggaattcatatccgggtgctatttctcagcaccccaatagaaccccagttaatattaattagttgatatgtaataaaataatccccactgtatatagccggcagataaaaaaatcgcgggattatacctccttttcgacaccgagccactatcaatccgttgacttttatcaagcataagcatttttccttttatttctgtctggcaggaaacctgcataaagctatcgcaaacgtttgcttagactgttagaattgccaccgttctgttttattcattcaaatgcaaccgcctgggggctacgcagtgaccaacaaaacctctcttagctataaagatgctggtgtcgatattgatgctggcaataccttagtcaatcgtatcaaaggtgtcgtgaaacagacccgtcgccctgaagtgatggggggattaggcggtttcggggcactatgtgcgctgccacagaaatatcgtgaacctatcttagtttctggtacagatggcgttggcaccaagctgcgtctggctatggatctgaaacgccacgataccatcggggttgatttggtcgccatgtgtgtcaatgatctggttgttcagggagccgaaccgcttttcttcctagattactatgcaacaggcaaactggatgttgataccgcagccagtgtcattacgggtattgccgaaggttgcaagcaagctggctgtgccctggtcggtggtgaaaccgccgaaatgccgggtatgtatcatggtgaagattatgatgtggcagggttttgtgtcggcgtggtggaaaagtcagagatcattgatggcagccaagttcaagtgggtgatgcgctaattgcactggcatccagtgggccacattccaatggttattcattgatccgtaaaatccttgacgtcagccagaccaatccggaaacagcagagcttgaaggtaaatcgctggcagatcatttgcttgtcccaacccgaatttatgtcaagcctgttcttgaactgattgaacagttcgagatccacgccattgcccatctgactggcggcggcttctgggaaaatattccccgcgttctaccggaaaatatgcaggccaaaatcaatgcctccagttggcaatggccagctatctttacgtggttacagcaggcaggcaatgtcagcaatcacgaaatgtatcgcacatttaactgcggagtaggcatgatcatcgctctgccacaatctctggcagaacaagcggttgagtggctgaacgcggcaggtgaaaacgcttggcagattggtactattaccgaatttgataccaatactgaactgaacaccaacgagcaacaagttatcatcagcgaatgaaaaccatgaaaaagattgtcgtcttggtttccggtaatggcagcaatcttcaatccattatagacgccagccagcaaaaccggattaatgggcatatctgtgcggtattcagtaataacgacaatgcctatggtctgcaacgtgcagaacaagcggatatccccgcccattttctcaatccgcaagcgttttcggatcgcacggcttatgattgcgccctgctcacagccattgatcaatatcagccagatttagtggtactagcgggctacatgagaatactatcgcctgattttgtgcagcactactgtgggcgcatgctcaatatacatccttctctgctgcccaaataccccggtctgcatactcaccgtaaagccattgaaaatggcgatcaagaacatggcacttccgtccattttgttaccgaacagcttgatggcggccccgttattttacaggccaaagtacctatttttgaggaagatcaggaagaagatgtcatcaggagagttcaggttcaagagcatgatatctatccgctggtcattggctggttcttagatgggcgtctgggaatgagcgataatgtagcaatactggatggcaaaatactgccacagcagggttacgcctcagaataatcgatactgctagaccccaaacttacagcattgtattaagacgaaacgtgttaaggtaagacgcgttaagatgatactttgctgtaaaccgtcattcagcttaaattctcttatacacccagtaaatcggctatttattcatctaacaaaatattaatctggcaataattatgtatctggtaataattaattatccgaacattaattaccgcgaatcatagttagcgtgggccaaatttaaaccagcctttaacaagcactgaggtatccaatgtccagtggttctgaaaatccacctgtaaatttacgtcctcttgagcgggaagatctccctttcgctcaccaaatcgataacaacgccagtgtcatgcgttattggtttgaagaaccctatgaagcttttgtcgagctatgtgatctctatgacaagcatatccatgaccaaagcgaacgccgttttatcattgagagcatgaacgccaaagtcggattagtggaattggtcgaaattgattatattcaccgacgcgcagaattccagattatcattacaccggcctatcaggggcaaggctatgcaaccaaagcggctaaacttgcgatggaatacgcattttgtgtattaaatctctataaactttatttaattgttgataaagagaatgaaaaagcgattcatatatacaacaaattagggttccataccgaaggcgaattaatcgatgagttttttataaacggctcttatcatactgccattcggatgtgtactttccaacaccactattttgccaataaagcctgcgaatcccagaccagctcgctggcccattaaactaaatggagtagtaatgtcccacgaccgcctctataacgaaaaagaactcagttggctctctttcaatgaacgtgtacttcaggaagcggctgacaaaagcaatccacttattgaaagaatgaggtttttagggatctactccaataatctggatgaattttataaagttcgctttgccgatgtaaaacggcgcattcttatcagtgaagagcggggttctgccaccagcggccgccaattattgaaaaaaattcaggctaaagttgtaaaaatcgatcaagagttcgatgagctctataacgatttattgttggaaatggcacgtaatcagattttcctgattaatgagcgacaaatatcccccaatcagcaaatttggttgcggcaatattttcgccagcatttacgcccacacattacacctattgtcatcaatccagaaaccaatctggttgaatttttgaaagatgattacacctatctggctattgaaattattcgggggcaagagacaaaatatgccctgctggaaattccctcagacaaagtcccccgttttgtcaatttgcctccagaaatgccacgcagacgcaaatcgatgatcttacttgataatattctgcgctatacgctggacgaaattttcaaaggttttttcgattacgatacgctgaatgtttattcgatgaaaatgacccgtgattccgaatatgatctggcaacagagatggaatccagtctgttggaactgatgtcttcaaccctgaaacagaggttgaccgccgaacctgtccgttttgtttatcagcgtgatatgcctgatgaaatggtggatctcctgcgcagtaaactggggctatccaatgatgactccgtgattgccggtggccgctatcacaatttcaaagacttcatcaagtttcccaatgaagggaaccgaaatctgctgaacaaaacaatgccacgactacgccatacttggtttgagcattttcgtaacggttttgatgccatccgtgagcaggatgttctgctctattatccttatcacaccttcgagcatgtgctggaattgctgcgtcaggcatcgttcgaccccagcgtgttgtctatcaagatcaatatttatcgtgtggcaaaagattcacgtattattgattcagtgatccatgccgcccacaacggcaaaaaagtgactgtggtggttgaattacaagcccgttttgatgaggaagccaatatccactgggcgaagcgactgactgaggcgggtgtacatgttattttctccgcaccgggcctgaaaattcacgccaagttatttgttatctcgcgtcttgaaggggatgaaattgtccgctatgcccatattggaaccgggaatttcaatgaaaaaacggctcgttcatacactgattattctttgctgactgccaagccggaagtcaccaacgaagttcgccgtgtatttaactttattgaaaatccttatcgcccagtcacgtttgagaatctgatggtatcaccgcaaaattcgcgagctatgctcaaccaactgattactcaggaaattgaaaatgccaaagcaggcgaagcggcgggcatcactctgaaaatcaacaaccttgtggacaaggaattggtggatcgcttgtatgatgcctcagaagcgggtgtcaaagtgcgtcttctgatacggggaatgtgctctctagtgccaaatcaggcgggtttcagtgagaatatacaagtcaccagcattgtggatcgcttcctcgaacacgatcgagtttatgttttcactaacaaaggggatgaaaaggttttcctttcttcggctgactggatgacccgcaatatcgattatcgtattgaggtcgcagtttgtctgctcgatcctcaattaaaacagcgggttttggatattctggaattgcagttcagtgatacagttaaggctcgctatatcgataaagagttaagcaatcgctatgttccacgcggaaataagcgtaaaattcgcgcacaaattgccgtctatgattacctgaagacattggaacaaccggagccaagagcctgatctatgccgttgaaacacgacaaaccaatgcccaaacccatggaaattgccaccattgatctgggctctaatagctttcacatggtgatcgcccgtattgtgaatggcgcactacaggtgatcgggcgtttaaagaaacgcgttcacctcgctgatggcctcaacagcaaaaatgaattaagtgaagaagccattaatcgtggccttgcctgtctttctctgtttgcagaacggttgcagggtttttcccctaataatgtctgtctcgtaggtactcacagcctgcgtgaagccaccaatgcacaagagtttctaaaacgggcgaaagaagtcatcccctaccccattgaaatcatttccggtcatgaagaagcccgcctgatcttcatgggtgttgaacatactcaaccggaaaaaggccgtaagctggtgatcgatattggtggtggttctacagaactggtgattggtgaagatttcgaaccgctgttaattgaaagccgtcgcatcggctgtgttagtttttctcgtcaattctttcctgacaacataataaacgaacaaaatttccgtagggcgcggcttcaggctgcacagaagttagaaaaccttgtttggcaattccggatgaaaggctgggattttgccttgggagcatcaggaaccatcaaagcagtgcaagaattactcgtcggattaggtgaaaaagatggtctgattacacctgagcgtctcaatatgctggtgaagcgggttctgaaatacaagaatttcaaatcactggatctgcctggtttatccgaagaccgcaaacaaacctttgtttccggcctggctatcctgtgtggtgtgttcgatgtcctgcatattcaagaactgcgcttgtctgacggggcactgcgtgaaggcgtactttacgagatggaagatcgtttccgtcatcaggatattcgtcagagaaccgccaaaagccttgctgaccattataatatcgatagagaacaagccgagcgcgtttggagtactgccaaaacactttacgatcaatgggtgacgcagaatccgaaacggctccagccacaactggaatcaattctgctttgggcggcaatgctgcatgaagtcggtttaagcataaacctgagtgggctacagcggcattccgcttacatcctgcaacacaccgatctgccgggctttaaccaagaacagcaatcattgctggcaacattggtacgctatcatcgcaaggccattaaagtgcatgagcatccccgcttttacctgttcaagaaaaaacaatatctcccgatgctccagatattacggttggcaacattactcaacaaccagcgccaatccaccacaacacccgagtcgctcaggctggacacttctcatggtcactggacgctctacctgccacaaaactatttaatcaaaaatgccctgatgcagctcgatttggaaaaagagcaggcttactggagtgacgtggttggctggtacttgcatatcaaagaggaaacggcgtaacgatatcaccccatgaagcagaaaaagaataccgttcagattatattatcgttagataacgggatcgccctgtttttttgcactatttttgcaccaaaggtacaccatgttacaaccggcctttaaatctggtaattcaactgttgccagtcaacattcccaaaagctggcagttgttcgccaacgtctgctgtctctttttattaacgataaattattcgttgatacgttattaggtcaggctgatgaacattcaacaatcagcgacgagcagttactggaaaaaattgaggaagtcagtgcgcagctggccaatctgcacgctgccgacattgcagatattctggaagccctgccctacgatgaacgtcttgctttatggcgactcatcgataataaccagcgcggtgaggttctggtggaagcctccattccggtctgggacaatttaatcaaggatatgtctgaccttgaattgttgaaagccattggcacactgcatgtggatgagcaggcttatattgcagaatatctaccccgcgatactacacgccgtttactgacttatctggaaccgagtcaacgcaaccgtattcgtgaagtattgcagtaccacaaagacagcatcggccagatgatggattttgagtttgtgacagtgcgaagcaacatcacactcagtacggtacaacgtttcctgcgttccagaggctcgattcccgacgcaacggataaaatttttgtcattgaccgcaaaaaccgccttcagggggaactcccgctcacaaccctactaaccaatgcaccggataagttggttgcagaagtgatgaatacagagactgtcactttcttaccagagcaaaaaggcgaggatgccgccagtgcgttcgaacgttacgatttaatttccgctgccgtggtggataataacggtcgcctgatggggcgtctgaccgttgaggatatcgttgacaccttaagtgaagaaacagacaccaatatccgacgcatggggggattaagccgtcaagaagatgtcttcgctcctgttgggcagacagtaaaaacccgctggacatggctcgccattaacttgtgcaccgcttttattgcctcgcgggtgattggcttgtttgaacataccatttcccaactggttgcccttgcgacattaatgcccatagtggcgggtataggaggtaacacaggcaaccagaccattaccatgatcgttcgggcgttggcactccaccaaatccaatccggcagtttttcttatctgttattgagggagttcggtgttgctctgattaacggtgttatctggggtggaatcatgggcgttgtcacctatctactctatggcgatcttgcgatgggcggtgtgatgacaatggcaatgatattaaatctgctgatggcagctctaatgggagtattgattccatttattatgatgaaactggggcgagatccggccattggttccagtgtgatgatcacggcaatgaccgatactggcggattctttatctttttggggttggcaacgctgtttttgatttgagcttcatgggagaaacgccgatttataaatgatatcggcgttttcgatcctgtttctaaatttgtgtcattgcctgtttttgatatgtttaatttatcaacgagaacaggtggcaagatgatatcctttgactatccgtgattaaacctgacaaactttgattgaatttatatttaaattcaatgtattaaattaaattcatgactattaatacttattaatgactaaaggtgattaaataaaatcattacacagaataatgaatcaataataaataattatttaaaaaacaattgaatatgaaaaataatgagtgtttttaaattaaaatgcacacatgtatgtacaaacaaaaaaaagtactctatatgacatgtagcaattgattttacactggctgaatggggggatcagttccgagatgagggataaaaaagcccggcgtctcaaccaaacattatgatcgctacgactacctgaaagaaaagccggagattgtggagaggtgggaagggaagctactgtctctatagggcagaaatctgccctttgacatacggggtatctgcacaaacaaaaggtattgaggaaatcccaataccctcacccgtgagtataaaaccaaagtaggcattccatttgaaacggaaggattgaattaaaaggtgagaaattcccacctttagataacttgttgattttgcttatttccggcatggggcgggaatttaattaaatcaagaggttaaattaaaggggaggattgtcccctttaaactcatagtcttatcagtcagccataggcaaatagattttgttaatgtcccaccaaccattccatgccatcctaatcagaagttctctccagtattgatgaacctttttattgatgttcaccggcggagaagtaacccgccttcatgttttttagcaatgttattgttgattaaatgagggaataaattatgcaagataaaaagcctgatgtgcctgtctcagaagatagcaatctcgttattgttacaacaccggaatatgtcaaagattcaatcaaagaagccattgcagcacacgccacaagccgtaaccatccttatgcaactcaggcagaaccgggatttgtcactttaaataatgaagtcaatagcgatagtgagttaaccgtcgcaaccctctaaggcagtaaaaacggcatatgacctcgccaatacagccaatcagaataccaagagtgcaaacgagagcgctgataacgcaaatgataatgccaatactcgcttaacaaagaccagacggagccgatattcctaataggaagaattggtaaaaacctcgnttagagccaagatggaaggattgc

SEQ ID NO: 14985 - DNA, 524707 bp, Xenorhabdus bovienii
  unsure (1)..(524707): unsure at all n locations
  Genomic contig Name=Xb4151_4152.C444
tttgattgcttatcgtactttgtcgtactctaacagagttccaggctcttttttttgctttccattgattttatccgttctcatcactttctataaaaatatttctgtgaatcaatatgaacagacatcatttgtcagcggctatttttgaccatcatcaaatagaagataaattcttttcatctatcagccagatgcatgcgcatatcagtgagcatgttcgagcctatgtgactgggcttggaacttatgctttaaattttttgttagtgacagatggtcagatgaaaacagaagaagtgctaaaaatggctattcagttgatggatgaaagtgtaagtgtcccttttggtatttttgccgtggagcctgacagcaaaactctggaagtgatcaaacaggccggatttgtgcccgatcctgatggtactacgacggctatgtggctggatttggctaattggcagatgggcgagggggcatttttggcgtatgaaatcagaaacgttgatcactgtctggcagactgggccatcccgatagaaagtgcgtttgaaacagggagtatgttatcagggcaataccagatatgtcatcaggctgctttggatgcagggaaatgtctgcaacactatgcattatatgtggatgggcagccgctttgtgctttaacgttgtcgaggatggataatattgttcgtcttgatgatattggcacagtcgtgggaaagcagggaaagggatatgcctctgctttaataaattatgttctgcatgaggccaaacagtatggtgcaggcgcgtgttatctggatgcttcccatgatggtaatgcgctgtatcaaaggattgggtttaagccattatttgaatatcagggatttatccgtgagtcataaaaaaacgcctgtcggaacagacgttttttaagtttatgagcacattccctgatcagtcatcaaggaagctgcgcagtacttctgaacggctcgggtgacgcagtttccgcagggctttcgcttcgatctgacgaatacgctcacgggttacgtcaaactgtttacccacttcttccagtgtatggtcggtgttcatatcgataccgaaacgcatgcgcagcactttcgcttcacgcgcagtcagcccagccagcacatcgtgggtggcagaacgcaggctttctgatgttgcagaatccagcggcagctccaatgtggtatcttcaatgaaatcccccagatgtgaatcatcatcatcacctactggtgtttccattgaaattggctctttagcgattttcagcaccttacggatcttgtcttctggcatcaacatacgttctgccagctcttccggtgaaggctctcgacccatttcctgcaacatctgacgggaaatacgattgagtttgttgatggtttcaatcatatgtaccgggatacggatggtacgagcctgatcagcgatagaacgcgtgattgcctgacggatccaccatgttgcgtaagttgagaatttgtaaccacggcgatattcaaatttatcaaccgctttcatcagaccaatattaccttcctgaatcagatcgaggaattgcaggccacggttggtatattttttcgcaatcgaaataaccagacgcaaattggcctcaaccatctctttcttcgcacggcgagctttggcttcaccgatggacatacgacggttgatatccttgacctgctcaatagtcaggccggtttcttcttcaatttggcgcagcttttgcaaactacgcatcacatcgtcttcaacttctgacaatttatcagaccacggcttgttcatcgcttttgctgcggtgaaccaagtatcagtcgtttcattgccagagaacagtgtgatgaagtttttcttcggcattttgcacagttcaacacacatcttcatgatttgacgctcttgaagacgtacacgatccatcatggaacgcatgttgttgaccagataatcgaactgtttcggtatcaaacggaattgtttgaatacttcggacagcgttaaaatttctgctgcggtattcggatggctgcgaccgtaactcttgattgactgacgggtcgtttcatattggtcgcgcagttcctgaaacttttggcgagccaattctggatcgatgctgttatcatcttcgctgtcagcatcgtcttcactttcttcgtcatcatcgtcgtcagagtcatcaagctctgcctgaggaagttctgagccaatgtgagtagctgtcggtgaaagatcttcttctgcgttaggatcaacgaagccagtgatcaaatcagacagacggcactcgcctgcttctacgcggtcgtattgctccagcaaatatgtgatcgcttcaggatattcggcgacagagcactgtacttggttgatgccatcttcaatgcgttttgcaatgtcaatctcaccttcgcgagtcagtagctcaaccgtacccatttcacgcatatacatacgaaccggatcggtggtgcgtccgatttctgactcgacactggataacacctgagcagcagcttctgccgcatcttcatcggtgtcgtttgtgttttctgccaacatgagatcatcagcatcaggtgcttcttccattacctgaatgcccatgtcattgatcatttggatgatatcttctatctgatcagaatcgacgatatcttccggcagatggtcattgacctcagcataggtcagatagccttgctccttacctcgggtgacaagtagctttagctgtgactgcgggttttgctccataagacggtatccacacttcagagtattggttggtatcggtcggcgaaacaaatatgccaacaataagttttcttgtattgctgctttctttaatagaggcaaccgtagggctatgaccctacctaatgcggcatttaagccgtgaattctgtgtcttcgtactaaattttggtttagaacctatttcatcaggctatattgcaataatcacaaattgccatataaccgagtaatatagtcctgttgagataggctcttattttctgtcaccggactctgtgattaatctgacttcttcacgttcttctggtgtcaggccttctgttctttctttggcaatcagaaagctgaaacgttcatcaagcgctgatgcgaaaagatgattcagcgcatcgctaaaagttttttcagcaatctcatctacctgtatatcgttccatgcggcgagcttttcaagctgttttgcgtacttattatcgcgatactgctctaaaagttgcccggttgttaagccaggttgtgcaagacatgtgtcgacaagctcaatgaataacggtaatcccgctatctgaactgaaaacaatccttgtaatgaaggaactaatgtcgctaaatgcggattttgcaccaacaatgcaatcaagatacgcattgttgttggcttcagttttagcgcctgataggtactggtatcttttttgacaagttttgccaaaaatcgttccaattgtgttgtatcaggtgttcctaacaggttaccaagttcttgcagcaggtagagtcgcagtgtttctcccgggacttgactgatcaacggcatagcaagcgagctgatcttggtcgttccttccggggtactcaaatcaacctgtggtaacagtgattcgaacaaaaatgtagacaaagtcagtgccttttccattctttgctcaaatacttcacgcccttctttgcgaatcagtgaatctggatcctcgccatcaggcaagaacataaaacgtaattgccgaccatcattcaaatagggcagcgccgtttccagcgctcgccaggcagcatcacggcctgcacggtctccatcgtaacaacagacgacattatcggttgttcgaaaaagtaactggacgtgttcggcagtcgtagatgttcctaacgaagccacagcgtagtcaatgccaaattgagccagtgcgacaacatccatataaccttcaaccaccaatagccttgaaagggaattgtggttctgttgtgcttcataaaggccatataactgtcggcctttatgaaaaatctctgtttccggtgagttcaggtatttgggaagcgcatctcccagtaccctgccaccgaatgcaatcacacgaccccgacgatcgcggattgggaacatcacacgctcgcggaaacggtcataagtgcggccattgtcgtttgtgaccagcattcccgcgtcgtttaactgctttcgctcttccgcattatgggcaaactgtttcaggacgttatcccaccccgttggagcaaagccgatggcgaagcggtggatgatctcttcactgagcccgcgtctgagtaaatattgttgggctgattggccgttgggcgtcgtcagtgaatgttgatagaaactgtttatcgtatccatcaactgataaaggttttgtctttggtggcgttcgatgtgaccgccgcctgagtttgcttcatagggcacttctaacccgtgcatagccgccagttcttcgatagattcgacaaaatcgagcctgtcataattcatcagaaaatcaatggcatttccatgtgcactacaaccaaagcaatggtaaaactgtttatcagcattaacagtaaatgaaggggttttttcgttatgaaaaggacaacacgcttgatgatttttgcctttctttttgagaggcactcttatatcgatcaaatcaatgatatcggttcttgctaataaatcattgataaatgcgcgtggaattcgtccagccataagcccttttacgcctgttgatgaacgagaataagccgcgcttcctttggggaaagcacggcctttaactgcagtagtttgttaatacaaccactatgcggatagaccgcaaggattagtacaaacgagtgcggcgtgcgttttcacgagcgagttttttagcgtgacgcttaacagcagaagctttagcgcgcttgcgttcagtcgttggtttttcatagaattcacgacgacgaacttctgctaatacgcctgctttttcgcaagaacgcttaaagcgacgcagtgctacgtcgaatggctcgttttcacgtactttaattactggcatgtgcctctcacctcaatagaaatcgggtttgtcgctggcgggatagtgccagccgtctttaaaatggtgcggaattttacttcaatgaacacggctttgtaaagtgccgaggcaaattgaaacacacaacgccacggattgcagcttgattttcagcacatcaacaagcaagtcggcgctagcgttattaacattaaccacacaggatattcaagtaggggactgattatagactaaacagaaaaaatagtcagcatgtaaatagagacagatttatccacctttatggaggtgcagttgatgtgattagacagatgtggttacacacagatgatggtacactgacgcccgtttaggggaatacagtatatgcgaatagaatagttgcaaatggcaactaaacaaacagtgacgagacaaatagttcaatgcgagttttaggtatagaaacgtcctgcgatgaaaccggaatcgcaatttatgatgacagaaccggtctgctagccaatcaattgtacagtcaggtcaagctgcatgcggattatggtggtgtcgtgcctgaactggcgtcccgtgaccacattcgtaaaacggttcccctgattcaggctgcgttgaaagaagccggtctgacgagcaaagatattgatgctgtcgcttacaccgcaggcccaggtttggtgggggcgctgttagttggggcaaccatcggtcgctcattggcctttgcgtggaatgttcctgctattcctgtacaccatatggaaggccacttgctggcaccgatgttagaagaaaatacgcccgagttcccttttgtcgcattgctggtttctggcgggcatactcaactgatcagtgtgaccggtattggtgagtataaactgttaggtgaatctatcgatgacgcagcaggtgaagcattcgataaaacggcaaaattactggggctggattatccgggcgggcctgtacttgctcgtatggcacagcatggcgaggcgaggcgttttgtcttcccgcgcccaatgacggatcgtccagggctggatttcagtttctctggcttgaaaactttcgccgccaatacgattcgcaatcatattcatggtcatgattccggcgaagatgaacaaaccaaagcggatattgcccgggcctttgaagatgcggttgtggatacactggcgatcaagtgtaagcgagcactggaacaaacgggctttaaacgtttagtgatggcaggtggtgttagtgcaaaccggacattgcgtaccaaaatgcaggaagtgatggaaaagctggggggagaagttttctatgctcgccctgaattctgtaccgataatggtgcaatgatcgctcttgctggtatgatgcgtctgcaaggcagcactgaaagtgcgctgggtgtgacagtcaaagcacgctggcctctggctgatctccctcctttgaaaaagtgaaaataccacgtggctacgccaatgatcgctaaactttagcgatcattgtatcgagtattagttaattatttattttttaatttcaataacatattgtggtcctcctgttttagaaccgcctattttgtatatgttagtgatggtgagcccaacctgttttaccagtgcttctaattcgaattgataccgttctttacctaataaaagaacatccatgtataaatcaaaggattctgcttctgcattactttgttctttaatcatatcgataatatatagagtcgaatctttgtgcatggcttgatgacaattttttagaatgtcagtgacacgttcatctggccaattatgtaaaacatttttcatgcaataggcatcatatcctgaaggaatagcggaaaagaaatcaccattaataaaggtaattccctctgattcttgtttgataaaatcatactgatccatgacagcacatctaatattgggataattttcttttattctttttgctaaagcgccgtatccgccaccgacatcaatgactgatgaaatattatgtagcggaatgtgctcaataatatattcattcattatattggtcacttttgacattaagttatcgaagttatctttaaggattttattcttctcatgaccaaaataatcaaaaaatttttcatgatgattaatttcaaaagccgatttattattttctttatttaaggaagcattatattttgcccaagaattccaattaattgaatctaattcaaattttatatgcaatgtctcaaggctattaggatcacttaatgatgagcactgttcggtaagataaaatttatcatctttttccagtaatacaccaagtgaacgcatataattgagtagtcggtgaaatctatcgacggaaacatgacatagtttagcaagttgctctgcggtttttccatcttgagtgcttaaatatgtcggggcattactttcaacaaaagtatacagtgcaatagatttacgatagacagtggtcatttctgtaagcattattgggtgtccttatggtaattattgtaactattattaatttatgtggtaattatttttgatatgcctatcagataatattgatatccgccatttttatttaatataaaaatggcggatatcatcatattcactaattaagtatgattaaatgtttttatgtgattaaaaaatattgtttcttattaaataaaagaggttgttttaaataagtatggcagatcatttcctttttggataagggctgctaacgacaattgaacaggctacagatatagggcggtgcttttcagaatcactttaatggaaaaggtaggcagccccttgtgggggccatctgttattactcgtcttgctgttcctgctctttaaccgcttgaattttttctttatccgtcatttcctgtttctttttcagcttctgccaaatacggctttcctgcccacgccaaaggcgctgaatattatcgtgatggcgcagaagtatcagacaggaaagcattgcgacgggaaaggttaattcaggtttaaaccaccaaacgtagaaaggagcgatcaacgcactgacaatggcacccaatgatgagtaaccgcttaacagcacggtcagcagccatgtaccagcaattaatcccataaggtcccaaccaatggcggcaatcgccccaaacgcagtcgcaacgcctttaccgcctttgaagcgaaagaacacggggtaaatgtggcctagacaggcgacaatggcgataatgcccaaataggtgggttgaatattgagtttgtacgccagccaaaccggaatcattcctttcaggacatcgcagataagcactgccagtgcagcacctttacctccgatgcgcagtacatttgttgcccccgggttaccggaaccattctggcggggatcgggtagtcctgccaaacggcagatcaatatcgcgctggatatggagccacataggtacgcgaagatgatcatgccaagtgcgatagcactcataagatatctccaatgaataagggtcgttttcttaactctaacaatggataatacgcacatttggccggaagtggtatccggtgaaccgaaaaacggggaaaaggtcgtgatggatatcgtatttatagaagaattagcggtcattactacaattggtgtttatgactgggaacagacaattaaacagaaactggtgttcgatatcgaaatgggatgggataacaaacgcgcgtcttccagtgataacgtcgaacactgtctggactacgccaaagtcagcgaagcggtgatccaccgtgtggaaagccagcgctttgccttagttgagcgggtggcagaagaggtggcggatattttactgaatcaatttcattcgccctgggtgaaaattaaagtcagtaaaccgggtgctgttgctcaggcaaaaagtgttggtgtggtgattgaacgcagttcaaatgatgtaatcataaatggctgatttgatcagctcctgcattaaaaaagcgcctcaaattgatagattatttggagcgcttttatcaattaccggaaataatcaagcatcaggaattaatcaatagttaatcaatagatggttgtttccatttggtgatggcgagctggcgttgcctatctaattcagtacggatctcagcgccctgaaatccacgggcaattacgtcttggacattcacctgactgacagtggtaaaggcgtcacgcaaataacgcccctgcggatagcgggatgcttccagttcggtatatgcacgggcgtcagcttggctacaaagaatcaactgctcaattcgttggggcttgcgccatgcgtccacggcattaaacaatgccaacagggtttctggaggcaactgctcggcagtgtgtacccaatcgtggtactgcgccacaatgacagcaagatcgcgtgctgtattgggaatgcgcagtctttcgcacatctgcttaacctgtatggcttcggtgtgcgcacacaatgaggcgaaacgaatatcgatttcttggctcaattgcgtggccatgtgtaaggccttcaatgaatgaatacctgcatccatttgaagggatgatttctcccatgaagaaataggggctacaccaaacaggcgatcgatctctgggaaaagaatagccagtgcaccacaatcatgtaaaacctgaaagtagatttgcggtgagggtgaagtaagtgccttttcggtttcccgccagacccgttcgggcgtcagggatgacaactcgccactcttcaccatttttgtgatgagtgattgggtttctggcgcaattgagaaactcaggtgagcaaagtaagcagcaaaacgagccagacgcagtacacgcaatggatcttctgaaaatgcgccagagacatggcgcaaaatacgatgcttgagatcatcagcaccatgataaggatcgatcaactcgccttcggcagtttgtgcaatggcgttaatcgtcaaatctcgacgcagcagatcttcttccaaggtcacgtcgggagcggcataacaggtaaaaccggtatacccctgcccggattttctttctgtgcgtgctagcgcgtactcctcatgggtttttggatgcagaaaaacgggaaaatccttcccgacctgttgatacccttgagataaaagttcttcaggatttcctccgactatcacccaatctctttctgtcacgggcagacctaagagttgattgcgaacagcaccgccaaccaaataaactttcacttttactcccttaaattagctcatccagcgatctttgcgtttgcgtcgtggaataatatgtggcagcacaagacccagaatgaggccgatacctgcgactgcgccgccatatatgaaccactgtaagataatttctctttgtttatcatctaactgtaaattggccatatctacctttttttcagctacagtcagtttgttctggatcttggcattttcttcttttagatcattaataatcttatcgctggcagacactttgttttgcatatctgcggtgcgttgcttccagttattatcaatattagccagcttactcgtcagggttctgatctcttgttccatagcaggaatgcgttcacgcaggctgggaatggtgctcagttcattggttaagatccagcttatacgccctttgctatccttgacttgtgagtaaccattttctgaattactactcaacaagatgacttcttcacctgaattcagcgaacccatgatacggtgttgattgcttgggccgctacgaatgtaagctgataattcatcagagacataacgtttttcttcagcatgtatggataacggtaaagtaaaaccgaggaataggataaataatcgatgtagtttttgcattctgtgctcaactgttcttttctttgtgtatgggactattgtgatcaaactactcaaactgatagtaaagagttaagtttgcaggtgcaatcagtaaaccagaatgagaactctcttaactgaccgaatacagaccttgttcgtggtttttttttgcgaagtgagcataatcattgttgagataaccccctattgtggtttattttttctctttaccccaacgttccccaaaagaagttactcgcagggagaagcgtgttctcctgcggaacttgcagtataaattgagagataaatatatgcgttctgtagaggtagagttaaaattgtctgtcaaacccgatgcgataccggcagttcgccagcaattgtttcagtttccccaccattatttttcaccacaacacctgactaatatttactttgagacgtcagataatcaattgcgtcgctgggatatggggctgcgcatccgtggttttgatggacactatgaaatgaccatcaaaacagccggtaaagtgttgggtggattgcaccagcgacctgaattcaatgtgccacttcatcatcctgaactggatttggctcagtttcctgcccatatctggcctgaaaataccgatattacacaattacaagatcaactgaccgcgttgttcagcactgattttacccgtgaaaagtggatcttgaaccacggacaaagtgaaattgaagtcgcattggatcaaggtgtcattcgttctggaaatcgaacggccgctatttgtgagtttgaactggaactgaaaaaagggaatgtggcagatattctgttacttgcagataaactggcattgcaggaggggctgcggttggcgcataagagcaaggcggcgcggggatatgcacttacgtatggtttgactcagaccgatttatcgcaggttcccgaaacgttgggatggcagcagccattatctgttcttctgcctgaaattttagcgcagtggcaggagcaggaagaaggatggctggcaggtatacctgaaggaaaaacaggattagagcaggttttagtgtggatagagcagcttacagaacaacaggcggaagcttttcctgtattaggctcattgcctgcattaaaaggggctttatcagcagtgaatgccgatgcagaaacattgtgttacagcgcatcatggctgcaatgtaagttagcgttaactcagtggttgatggctcaagcacgataaaaccagtctctataaaataatcgtaataataacgatacgataacgaacggaaaccctgctatgttgccactttcagtgcctttggctcaccaattacagcatgtcattgctaatttccaacaatcagcgggaacaataaaatcctttgtgccacatgaacaggcggtgttgtctctgagtgactttgtggcggaaaatctgctgttacatccggcatggcttgatgaaatccgtcagaatcctcctcaaccggaggaagggcaacactattctgattggttaaatcaggcgttgtctgtggcaagtgatgaaaattccctgatgcgaattctgcgcctgtttcgtcaccggatgctggttagaattgcgtggttgcaggcactacaaggcagtacgacagagcagacactgcgacaactgagtatgttggccgaagttttgattgtggcagcccgcgataggttgtatctgcgttgctgtcaggattggggaacgccaaccaatcatgaaggcgtagcacagccgttgttaatccttggcatggggaaattgggcggtggggaactcaatttttcctccgatatcgatctgatttttgcttatcccgaaaatggtgtgacacaaggtggacggcgcgaaatggataattcccagttttttacccggctggggcagaaactcatcaaagtgctggatcaacaaacggtggacggatttgtttatcgtgtagacatgagattgcggccatttggtgatagcggaccgctggtgttcagtttttcggcactggaggattattatcaggagcaaggacgtgactgggagcgttacgctttggtgaaagcacggatcttggggtacgacgagcaggtgtattgccaggaactgcgccagatgttgaggccgtttatttttcgccgttatatcgatttcagcgtgattcagtctttgcgtaatatgaaaggcatgattgagcgggaagtgcgccgtcgaggtttaaaagacaacattaaactaggcgcaggtgggatccgtgaaatcgaatttatcacacaggtatttcagctgatccggggagggcgggagccgagcctgcaatcccgttcattgctgctgacattgaaagccattgaagtattggcattgttaacaccggaacaggtgagagagcttgaagaaagttatctatttctgcgtcggctggaaaacttgctgcaatccattcgagatcaacaaacgcagactttacctgaaagtacgctggatcgcgcccgcttgtcttggggcatgggatttgcagattgggatgggttgttggcggaaacagagcacaggatgcatgctgttcgaagtatcttcaggcaattgatcggtgatgaaactgacgaaaatgtcgaagaagccagtcatgtaccgtttaagagtgtatggcaggaggctttgaccaggagtgaattgatgatgcttgttcctcatcttgatgaggaagatgctcagaaagtgctcgatgtgattgccctgtttcgtcacgatgtcagtaagcgcactattggcccacgcgggcgtgatgttctcgatcagttgatgcctcgtctgctggcaaaaattggggtgagagaagataccaatactgttttggaacggatggttcctttgttgctgagtatcgtcagccggacgacttatttggagttgatgctggagtcagagcaggtaatgattcacgttatccgtctgtgtgccgcttccccaatgattgccagccagctgtctctccatcctttgctgctggatgaactgcttgatcctaaatcgctgtatgaaccgctgccacttgaagcctaccgggatgaactgtaccaatatttactgcgaattcctgaagatgatgaggagcagttgctggaggcactgcggcaattcaagcaagcgcagttattgcgcattgctgcggaagacatttcgggtgtactgcctgtcatgaaagtcagcgatcacctgacttatctggcggaagcgattatcgggactgtggtacagcaggcgtggaaccagatggtaaaacgttatggtgcaccagcacacttgtcccgacagcaaggactgggttttgccatcatcggctatggcaagttgggaggatgggaactgggttatggttctgatctggatctggtgtttttactggattgcccaatggacgtagtgactgatggagaacgcgccattgatgcccgtcaattttatttgcgccttgcccaacgtattattcatttgttcagtacccggacagcttcgggagtgctttatgatgttgatgcccgtttgcgcccatccggtgaatcgggcatgttggtcagtaccctcgatgctttcgacgattaccagaaacatgaggcgtggacttgggaacatcaggcattaattcgggcgagaatggtgtttggtgatgagaaaatgcgtggtgattttgaacgtattcgacatgaaactctatgccggcctcgcgatccggatctcttgtgtcagcaagtgcgtgaaatgcgcgagaaaatgcatcgtcatttaggtagccaccaacatgaccagtttgatatcaaggctgatccgggtgggatcacggacattgaatttatcgctcagtatcaggtactgcgctatgcaccggaaaacgcaaagctgacccgctggtctgataatgtacgcattttcgaattgatggccagctataacattatggatgaacaggaagcgatggcgctgacgcaggcttatattaccatgcgtgatgaactgcatcaccttgccttgcaggccttacccagtcgtgttcctgccgaaagcttcagccagcagcaaatattggtgcgcgatagctggcagaaatggctcggtcgttgataatgtgagggaaaccgagcttttcctgctggatcttgctggcattcagttaggttatggtaatatccgcaacagtttattttgatacttggagtatgggatgaaagtaacactccctgattttcaccgcgcaggcgttttggttgtcggcgatgtcatgttagaccgctattggtacggcccaaccagccgcatttcaccggaagcaccggttcctgtggttaaggtggataccattgaagagcgccctggcggagcggccaacgttgccatgaatattgcatcgctgggggcaaatacacatttgattggtctgacgggcattgatgatgctgcgcgggcattgagtgaaaaactcagtagtgtgaaagtccagtgtaatttcgtttctgttccaacgcatccaaccatcacaaaactgcgggttttgtcgcgtaaccagcaattaatccgtctggattttgaagaaggcttccaaaatgtggatgcccagccaatgctggaaaagatccaacaatccctgccttatgtcggtgcgttggtgctctcggattatgccaaaggtgcactgagtcagatccagacaatgatcaaactggctaatgaagcccatgtgcctgtactgatcgatccaaaaggcagtgattttgagcgctaccgtggcgcaacgctgctcacaccgaatatgtcagaatttgaagcggttgtggggcactgtaaggacgatgacgagctgatggaaaaaggcacaaaactggttcaggatctggaattgaaagccctgctcattacccgttctgaacggggaatgagtttactgcgcgtagggcagccaactttgcatctgccaactcaggcacaggaagtctttgatgtgaccggggcgggggataccgtgattggcgtactcgcaacggcgctggccgcaggaaaaccattgaatgaagcctgttatcttgctaatgcggcggcaggtgttgttgtcggcaaactgggaacctccactgtttcgccagtggaattggaaaacgcagtgcgtggccgagcagaaaccgggtttggtgtgatgagcgaagcacaattgaaagacgtggtggcacaggcgcgtcagcgcggtgagcgaatcgtcatgaccaatggctgtttcgatatcctgcatgcagggcatgtttcttacctgtccaacgctcgtaaactgggtgatcgcttgatcgttgccgtcaatagtgatgcttcgactaaacgtctgaaaggggaaactcgacccgtgaatccgttggatcagcgcatgatcgtattgtccgcactggaatcagtggattgggttgtggcattcgaagaagatacaccacagcgtttaattgcaggcgttctgccggataccttggtcaaaggcggtgattatacgccagatgagatcgcgggcagtcaggaagtctgggcagctggtggggaagttatggtattgaattttgaggatggtatctcgaccagcaatatcatcaacgctattaaaaaccagtaagtttaccgcatcttaccgcgtcattatgccgttatgtttcttgtgggacataaacggcattgtctaagttatgagggagaattgtgtacagtggcaattctccttacgcaattattccgcttgctcagtcttcttttcaattcctgcctgcgggtttccgatacgggcttccagttcgttcaggcgttgttccattgcggccagtttttcacgggtacgcagtaaaacctgggtctggatatcaaactcttcacggttgacgagatccaacttgctcagttgggattgcaaaacagtccgcaattttttttctacgtcatcaccaaattctttcacgcctttcggcatagaattgtggatctggcgggcaatttgttcaattttctttggatcgagcatgatgagcatccttttgtgacataacggtgttgtcgctattttaatacctgatagcgaaagcataaatgattgcgggccaggtttcataattgattttgttgattgcccctacgaattattagagctatagtgcaaatgtttatctcagggcagggtgaaagtccctaccggcggtaaagtgaaataactttctggtgatttcattaagcccgcgagcgctctgtttgcagttatctttttgttgttctcagatgtctcagaacaacgatggataaaacagaggtcagcagatccagtgtgattctggagccgacggtgatagtccggatgggagagaataacagcatcaatcaagtgcttgcgcttgcctgttgttttgttgcgtattttttgcagcatcaactcctcaaaattgccctgattctggtaacccataaatttaaagaggtttttttaccatgaatcagacgctactttcctcatatggcacaccatttcagcgtgttgaacgtgcaatcgctgctttacgcgcaggccgcggagtgatggtactggatgacgaaaatcgtgaaaatgaaggtgatatgattttcgctgctgaaacgatgaccgtagaacaaatggcattgaccatccgccatggcagcggaattgtgtgtctttgtctgaccgaagaacgtcgtcagcaactgcaattgcccatgatggtggaaaataactccagtcagtatcagactgcttttaccgtcaccattgaagcagcacaaggggtgacaacgggagtttctgcggcggatcgcattaccactattcacgccgccattgcagagggtgcacagccaaatgatctgagtcgaccagggcatgttttccccctgcgggcacagccgggaggggttttgacccgtcgtggtcatacggaagcgaccattgatttggttaaactggccggttttaagccagcaggtgtgctgtgtgaactaacaaatgatgatggctcaatggctcgtgctgctgaagtgattgaatttgcgaaacagcatgatatgccagttgttaccattgaagacttagtagactatcgccagcagatggcgaaggctgccagctagatcatattgttttctgccatattgttttcttgggtgaaatagaaagctgttcggaatagaaaacgtatcggaatcgaatataccggttatattgcgtgtacgcttgaaaggccgcagtccaccccctgcggccttcagtatttttgaaatactccatcatttttgattggctgtattcaaggaagaaaagtcgtaatcttgccataatatttttgttgttattgacaatcgacgtaatccagaatgtttaatttgctgtatgagggacgagaatgagtctcctgaaaatgcctgctttattcgttggtcatggtagcccaatgaatgcccttgaagataaccgctactcacgtgcttggtttgaactgggaaaaaaattgcccagaccgagagccattctggtgatttctgcacattggtacactgatggaacggttgtgacagccatgactcagccaagaactatccatgattttggtgcttttcctcaggcactgcacgatatgcagtatccggctaaaggttttcctgagttggcggtgttgatacaagatatccttgatcccattgaggttgaaaccgattttggagattgggggttggatcacgggtcttggggtatcttggcgaaaatgtatccagatgcagatattccggtgattcagttgagcatggatcgcaaccaaccggcttcttttcattatgaaatcggcaagaaattagctgtactgcgagatgaaggcattctgattatgggcagtggtaatgtcgtgcataacctgccggccgaaaaactgggtgcagagccttattcttggtcgctgtcttttgagcagtttgtccgcgaaagcttgactagccttgaggagccacatcctttgttccatgcattggacaggggagatggcaaattatccaacccaacgccagaacatttcctgccgctgttttatgtgataggtacatgggacaaaaaagagccgatttcaactcctgttgagggtattgaagatggctctttgagtatgttgtcgattcaagtcggataactgcaaatcagccaaccgacttaatccaaaatacttagtctaaaataatatgcgggtaaaaccgtgaaagatcttgtgtaatcaattcacgatcttcacggatacaaatacccgcagattgatcatcgaccagccagctgcctaccagcgtatagctatcgccaaattttggcagggcatggaattgctgtacgatcatgccttctttcccataggggccatcggcactggcgatttccctgccttgctcgataatgcgaatattggcaccttcacgggaaaataaaggcttaatgacatagctatccatttctgggtagtgttcatcggcaaaataagccggcagcaagttcggatgattcgggaacattttccacagcatcggcagcagcgctttgttggagataatgctcttccatgcaggttccagccagcggacgccagcatcggccagtttggttgagaaaatctcgcgcagcataaactcccacggatacagtttaaacaggttgccgatcacttgattctgcaagtcggtaaactgccctttttcacccagaccgatgtcttcaataaacaggaattccgtcggaatacccgcttctaaggcacaatcctgtaagtattgaatggtaccacggtcttcctcagtatcctggcagcaagccatatggagcaagccaaacccatgcttttcacgtaattggtcaaaacgctcaatcagcttttcctgcaggctattgaactgatctgcattagcaggcagatttccagcattgagctgatcttccagccaaatccactgaaagaaggcagattcatacagtgaagttggggtatctgcgttgttttccagcagcttgggcggatttttgccatcataggcgaagtccaaacgggaatagagcgaaggctggctggttatccatgaagaacgaataaactcccagcaatgtttagggatctggaatttagtcagcagttcttcactattgacgactttttccactacctgcaaacacatttggtgtagctctgccgtagcatcttcaatttcttcaatctggctcagggtgaattggtaatacgcttcttcactccagtagggctggccatgcatggtgtgaaagttaaaaccatattctgttgctttttcgcgccagtccgggcgctcggtaataccaatacgtttcatttttgcttaaccacccatagaacgggaagtggaaccggaagatgagcgctgcatggtagactgtttcgctacggaatccccgaagccaccgcgggtaacggtagttgttgttgctggttttggtgccatcgccgtttttggtactgtcatggtgcgaccgcctgcggcggcagagccataacttttgccggtagcatcaacaaacttgccgttggctgggctggtggcggattttgatgtaaataacggttgtgatggtgtagaactaccgcccatcaaacgtcccatcatgtagccagccatcaatggcatccagaaactcccgctgctgctttgagcctgagcctgggttccaactccagcttgagctggggtctgggtacattgttgttcaccaaactcagcaacacactcctcgcgagaggcatatttcggtgcggttttttccgcttctttcagagcattgttgtaagcggtcttgcattgctcactttgagaaggattcgcctgagagcactcatcggcatttgtatagagtgataccgtttcatcgttctgttcacaggccgatagcatgaaaaccgcactgatagcgagtgccacaggtgccaaacgataatttcgccacgttttacggaaagtatcgtggtttatctcttttgtccgtttcattgtcatagggggcatccaccttggaggtatttgaataagagctaatcccattaatggcgctcaacgggacaggctcttggggatattcttaaaaaatagcccacacaatgggcgggctgcttttctttatagtatagcgtttttaatataacgttttttaatcaggaacgatagctcattaaatcagcgagttgttggtgttttcatctctttaataatattgctagaatccgttgagatctttgtgcctaaaatactattgagtgccaccaaatcatcttcatttaaggtgccacgagcctgcttattcactagttgattaatcagatagtcataacgtgccttggataggctctgtttggcttgatacagcttggttgtggcgtccagaacatcaacaatggtacgggttcctacctgataaccggcttccattgaatccagagaactttgtgtagaaacaactgcctgtttattggctttaatgctgctgatagaagcggaaaggttattggaggaggagtgaacatcctgaataaccttgcgataggtattctccaagtcctgactggcactgacaaagttatattttgcctgttcgacctgagaattggtgagaccgccgctataaagtggcaggcttaatgataaaccaacgttgttaccgccatcgtaggaatcaattcgttgggtaccacgtttatggctattgatgaccccagtgcttgccgtcaaattaatagtaggcatgtagcctgtccgcgcatctttgataaattcgcgttttagatcctgtgtcaaacgtgctgataacaggcttaagttgcgggtttcggcttctttccgcacagaatcaacgggattaggttgattggttttgaatcggtcaatattcaatgaagccagttgtgggtagtagattcctgtcatcagacgcagtccttccagcgaattttccagattgttacgatctgaaacttctaacgcaagaatggtatcgtattgggcttgggcgttttgtacgtcggtaatggcaaccagaccaaccttaaagcgttggcttgattgatccaattggcggtacagcgaggctttctgtgcttcggtataggttaacgcatcaattttactcaagacatcgaaataagctttggctgtatccaaaattaatttttgctgggcgatctggtaactgatatcagcgatacctgcagatttttcagcctgattcagttgataccattttgacatgtcgaaaatggtttgcgtcagttgcagttttgcatttgtcccatagctttctgagtctgctttactgcgaaaacttttgccgtagtcaacaccagcattcagcccaagctgtggtaacaaagggctacggacttcattaattttttcaataattgaattgcggtcagcctgcgccttaagcaattcggggttagtttctttcgcctgcttgtaaatttgtaatagatcttctgcatggcttaaagtgctgaaacctaccagattcatagcgataaaaagagagagcaattttttcatttgcgttccttgttgtgcagctattttgcttaatttgcctctgagtataggccaatgccactgattttagcagagaatgccagtaagttagggaggctgtttgtgccatcttgccttatttttcggcgtgtttgtatcatcaaagcgaatttatttagatcaatctggaaaaatacattttaatgataggcaattaaaaaaatatttaggagactttatgagtgaaaatctcgtttcaccgctcacgtttacgacgcaggatgttgaaattatctcccgaaaaacgctctaccgtggttttttcaaaatgaccgagtatcaattcaggcatcgcctgtttcgaggaggatggagcgataacatcaaacgggaagtttttgaacggggtcatgcggctgttctgctgccttatgatccggtacgtgacgaagtagttttgattgaacagatccgcattccagctattgaaacgagtgaaacgccttggttgttggaagtgattgccggcatgattgaagaaggcgaagacgttgagcaggtcgttcgccgggaagcgatggaagaggccggtcttgaagtcaaacgttgtcagcctgccctgagctacctttccagcccgggaggaacgacagaacgcatggcgatctttgtcggtgaagttgatgctgccacggcgtcaggaatacatgggctggctgatgaacatgaagacattcgggttctggttgtcagccgtgagcaggcctacctgtgggtggaagaagggattatcgataatgcggcttcggttattgcaatacaatggttagctctgcaccatgaaaagctcaaaacagcatggttaggaaaatagttcctaatttatgctggaaaacgggaagtgtgtcccagtcagcagatcttttttgtaaagaagcgctagaataattcttatgactgacaggaaaaggaaaccatttggaaagcctgcttaaagtacctgtggcggagggagccacagccagaatactgcaaatcactgatacgcatcttttcgccagtaaaggcgattcgctactgggcatcaatacctaccgcagttaccatgctgtactggatgcgatccttgagcagagtattgatattgacttgatcgttgccacaggtgatttggttcaggatcagacgatcggcgcctatcagaattttgctgaaggtattgcccgtctgcctgctccctgtgtttggttgcccggtaatcacgattatcagccggcaatggtcgatgtgctggcggcggcaggaatttcaccttccaaacaggtactcattgggcagcattggcagctggttatgttggatagtcaggtgcagggcgttcctcatggtgaattgacggattaccagcttgaatggttgcaaaaatgtctggataagcataatgatcgcaatacgattgtgatgcttcatcaccatcccgtgccatctgggtgcacatggctggatcagcatagcttacgcaatgccccggctctggcagaatccctgaaggataaactacaggtaaaagcgatattgtgcgggcacattcatcaggagctggatagaatgtggaatggcatccgtgttatggcaacgccatcaacctgtatgcaatttaagccacattgtactaattttatgcttgatacagtggctccgggatggcgttatcttgaactgtctgtggctgacaatcgggaagcgaaactgcaaacgcaggttcacaggctgaagagtaatgaattttgcccggatttagcttcggacgggtattaatgtcaacgttactttatttacatggtttcaacagttcgccacaatctgcgaaagcaaatgcgctgaaaatgtggttacaccagcagcacccggaaatcgacatgctcgtgccacaattgccttcttatcctgaagacgcggccagtttgctggaagatttggtaatgactcgcgccggcgaaaatatcggtctggtaggctcttcgtttggtggttatctggctatctggctttcacaatgctttggcctgcctgccgtagtcgtcaatcctgcggtacgcccatttgaccttcttcagaattatcttggggaaaacgtgaatccctataccgaagagcggtatactctccagcaaagtcacatttatgatctcaaagtgatgcacattgacccgctggaatcgccagatcttatctggttattgcagcagacaggagatgaaatactggattatcgtcaggccattgcttacctgatgcaatgcaggcagacagtcgaatcaggtgggaatcatgcttttattggtttcgaacattatttccctcaaatcatcaacttcttggggctaaccagtggcaataacaaaaaaattgccaaaaataagtaagtgactggtattatcaacagtatatatcagtactgattagccctttaatcacgaagcaaccgacagaattacaacatgactcaatctagttacaacgcagaggccattgaagtcctcagtggcctggagccagttcgtcgccgtccaggaatgtacaccgataccacccgtccgaaccatcttgcacaggaagtgatcgataacagcgtggacgaggctctggctggtcacgcgaaacatattgaagtgatccttcacagcgatcagtctctggaagtgatagatgatggccgtggtatgccggttgatatccatcctgaagaaaaagtttctgctgttgagttgatcctcactcgtctgcatgcaggggggaaattctccaataaaaattatcagttttccggtggcctgcatggtgttgggatctctgtggtcaacgccttatccagaagggtggaagtgacggttcgccgtgacagccaagtccatcagattgcctttgaaagtggcgataaagtgcaggaactggaagtcatcggcagttgtgggaaacgtaatacggggacgagtgtccatttttggccggatgagagttatttcgatatccctcgtttctctgcatcgcgtttgacccacttgctgaaagcaaaggcggtattgtgtccgggtgttgagattgtctttaaagataagctcgcgggtacagaacaaaaatggtgctatgccgatggtctgactgattatctgctggaagccgtcaatgggttggtgacattgccgcagacaccattcgtaggggtattacgcggtgataccgaagcggttgactgggcgttgctctggctgccagaaggcggtgaattgctggccgaaagttacgttaacctgatcccgaccatacagggcggaactcatgttaatggcttgcgccaaggtttgctggatgctatgcgtgaattttgcgaattccgcaacatattgccgcgcggagttaaactctctgccgatgatatctgggatcgctgtgcttacgtgttatctctcaaaatgcaagatccccaatttgccggccaaaccaaagaacgcctctcttcacgtcagtctgcggcctttgtttccggtgtggtgaaagacgccttcagcctgtggctgaaccagcatatccaagacgcggaacaacttgctgaaatggcgattgccagcgcacagcgcagaatgcgggctgcgaaaaaagtcgtgcgcaaaaagctgaccaatggccccgctctgccaggcaaactggcggattgtacctcgcaggatctgaaacttaccgaactgtttttggtggaaggagattccgcaggcggctctgccaagcaggcccgtgatcgtgaatatcaggcgatcatgccactgcgcgggaagatcttgaacacatgggaagtctcttcggatgaagtgctggcttcgcaggaagtgcatgatatttctgtcgctattgggatcgatccggacagtgatgatctcagccaattgcgttacggcaaagtctgcatactggcggatgcggattccgatggtttgcatatagcaacgctgctgtgtgctctgtttgtccgccatttccttactctggtgaaacgtgggcatgtctatatggcgatgccgccactgtatcgcattgatcttggcaaagaagtgcattatgcactggatgaaggggaaaaaggcgccatactggaacgtttaagtcgtaaacgtggtaagccgaatgttcagcgcttcaaagggttgggggaaatgaacccaatacagttgcgtgaaactacactggatcccaatactcgccgtctggtgcaattgactatcgacgatgacaattatcaggaaaccttctcagtcatggatatgcttctggcgaaaaaacgctcggaagatcgccgtaattggctacaggagaagggaaattccatcgatattgaagtatagcgccgagatatagagcgcataggtagtcaacacagattctgaggaaattaatacatgagtgagataactcacgatggtgtggagtgccagccgctgcacacattcaccgaaaacgcctatttgaattactccatgtacgtcatcatggacagggcgctgccttttatcggtgatggtttaaaacctgttcagcgccgtattgtgtatgcgatgtcggagctggggctgagcaacagcgctaaattcaagaaatctgcccgtaccgttggtgacgtgctcggtaaataccatccacatggcgatggcgcctgttatgaggcgatggtattaatggcacagcctttctcttatcgctatccactggtggatggtcagggtaactggggggctccggatgatccgaaatccttcgcggcgatgcgttataccgaatcccgcttatccaaatatgcagaattactgctgagtgaacttggtcacggtacggtagattgggtgccaaactttgatggcacgttgcaagagccgaaaatgctgcctgcgcgtctgccgaatatcctgctgaatggcacaacgggtattgccgtcggcatggcgacagatatcccgccgcataatgtccgtgaagtagtcagtgcgttggttgctatgttggataatcccaattgttcgcttgatgatgtaatggaatacatcaaagggccggattatccgacagaagcggaaatcatcacgtcaaaagaagatatccgcaagatctacaaaaatggccgtggctcggtgcgtatgcgtgcggtgtggtcaaaagaagaaagtaatgttgttattacggcgctgccacaccaagtatcgggtgcgaaagtgctggaacagatcgccagccagatgcgggcgaaaaaactgccgatggtcgatgatctgcgtgatgaatccgatcatgaaaatccgacccggctggtgattgtgcctaaaaacaatcgtgtcgatgttgagcaggtgatgaaccacctgtttgtgacaaccgatctggaaaaaagttatcgcgttaacctcaacatgatcggactggataaccgtcccaacgttaaaggtttggttgagatcctcagcgaatggttggttttccgccgagagactgtgcgcaatcgcctgaattatcggttggaaaaagtccttaagcgcctgcatatcctggacggtttgctgaaggcctatctcagcattgatgaagtgattcagatcattcgcaatgaagatgaaccaaagccagtgttaatgcaacgttttgaactaactgaaacccaagccgaagcgattctggaactgaaattgcgtcacttggctaagctggaagaagtcaaaattcgtggcgagcaggatggactggcaaaagagcgtgacaaacttcaggcgatcctcggttctgagcgtaagctgagtactctgctgaaaaaagagattattgctgatgctgagaactatggagatcatcgccgttctccgctgaaagaacgttctgaagcgaaagcgatgagtgatcacgatatcctgccttcagagccgattacggttgtgctgtcagaaatgggctgggtacgcagtgctaaggggcatgaaatcgaccctgctggtttgaattacaaatcgggtgacagcttccgtagtgcagcacgtggtaagagcaaccagcccgtcgtctttatcgatacgacagggcgcagttattccgttgatccgttggatttgccctctgccagagggcagggtgaaccgctgacgggtaaactattggcattaccggcgggagcatctattgagcatcttctgatagctaaagaagagcagaaattcttgatggcatctgatgcgggttatggttttatctgtacattcagtgaccttatagctaaaaaccgtgcgggtaaggcgcttataaccctgccagaaaatgctaaggtcatgcagccactggagattaccaacgagcaggatgatatgttgttggcgatcactaaagagggtcgtatgctgatgttccctgtggcggatcttcctcagctttcgaaaggcaagggcaataaaattgtttccattcctgcagcacaggcggcatcaggggaagatatgttgagctggttgttagtcttgccagtacaatcctcaatcacgctctactttggcaagcgtaagttactgcttcgtccagaagacttacagaagttccgggctgagagagggcgcaagggaacctcgttaccacgtggattacagcgtgttgagcgtattgaagtggaaatgccccggtcataggccgaaggcagtaacaaaacgatttttgttacacaacaatcacaatagcaggccagatttattctggcctgctttataagaggcggctatgttagcaatcattcgtggaattattgtttttctgttatcaatcctgatatgtctatttggtagtatctactgtttattcagcccccgtaatccgagtcatgtcatgacctttggtcatgcatttggcaaattgcacaaaatatttggcattaagatgctggagcgcattcctgaagaagcgaagcaatatgggccaagcatctacatcggtaatcatcagaataattacgacatggtcaccatgtcgaatgccgtgcagccccgcactgtaaccgtgggtaaaaaaagcctgttattcattcccttttttggtccgctttactggctgacgggcaatattttgatcaacagagaaaaccgctcaaaagcacacggcacaatttcacaggttgttcaacaaatcaaaaaaaggcatatttctgtctggatgttcccagaaggcacccgcagccgtggccgtggtctgctgcctttcaaaacaggtgcttttcatgcggcgattgcagccggcgtacccatcgtgccagtctgtgtttcttccacacatgatcgcatcaaattcaatcgctggaataatggcactgtcattgttgaaatgctgccccctattgatacgacgaaatatactaaagatcaggttcgccagctggcagagcattgccgtcaaatgatgcaagccagaattgaagagctgaataacgaagtcgaagtaatggataagcgcaaataatcaaattgctgttggttagacttaatttcataacctatcttctcctgctctttggacggattctggctataaatttaagatagttttagagtttgcactttattcgcgatatgattgcgtttaataagttagtgtttttattaaacgcaatctgtagaaaaatcaatcccaatagcctaaatattgggtaattcatcccagtaattatttgaattgtgaagtgcttgcgttcatataagcaatcatttggggattgctattcctgtcgtggagaaaatatgtcactgagtcggcgccaatttatacaggcttctggtttggcaatgtgtttaggtgcgctcccttttgcggttcgggccaataaatatcaacaaacggcactgccgatcccccctttactggaatcccgtggtggccaacccttgtttttagccctgcaaaagacgcattggtcttttgatggcaaaaataaggtgcaagtttggggaatcaatgggcgatatttagggccaaccattcgggttcgtaaaggggataacgtcaagctgatatatagcaatcgtttgtctgaacctgtatcaatgactgtaggagggttgttggttcccgggacattggtaggaggctcggcgcgcctgatatcgtcaaatgaaaattggtctccgattatccctattaatcagccggcagcgacttgctggtatcatgccaacacgccaaaccggatggcacagcatgtttatgccgggcttgcaggtatgtggttggtggaagatgaaaacagccgcagcttacctctacccaaaaattatggcgttgacgattttcctgtcattttgcaggacaagcggttagataattttggtgtacctcagtataacccggcgatcaatcaaggttttcttggcgatacattgcttattaatggtgttgaaaacccttttattgaggttgccagaggctgggtcagattacgtttattgaatgcttccaatgcccgccgatatcaattgcaactcagtgatgaccgtcctttctatatggtaggtactgatcagggattgttgcctgctcctgtgacggtacagcaattgtcacttgctccaggggagcgccgtgaggttttggtcgatatgtcgaaagtggatagcgtagccattaccgcaggagaatcggcaggcatgcttgaccgcctgaaagggctgtttgagtcttcaaccaaattgttgtcaacgaccgtcctgactatcaaggccagtgggctgctttctctcgtgacagatcaattaccgacgcagctcgtggcggatactacggaaattaactcatccattcataatcgtcagtttgttttgggggatgcgactcaggggatcaatggggtattgttgaataggaatcgaatcgacatcagcagccagcaaggtgcgtgggagcgctgggtagtcactacttcagttccacagcctttccatattcaaggggggagattcaaggtcatcagccataatggaaatcgaccatttccacaagattatggctggaaagatacggtttggattgagggtagaaccgaattactggttaatatgatgcagccgtcttatgagatctttcctttcaagtactacagtcaaatattggaaatggcggatgacggagtggctggccaaatggttgtcactccagccacgagctaaggaaaaagccaataataataaccaccattgctttgcctgatgttggaataataaaagtgcctcaaagccctgtcagagcagatggggctgttatttcagaaaatctgagtgttcctgatggcgtgattacttgcctgaaacgtagtgcatgaactcactatttgttctgaataaattgctaatcttatcgactgagagtagccctttccgtatagtgtccaaaattttcatactatttatttgcctgtaaggtgacctaatgaatatcagcttgattgctgcgatggctatggatcgagttattggtatggaaaatgccatgccgtggactctgccaggtgatttagcctggttcaaacgcaatacactcggaaaatcggttgtgatggggagggtaacttacgaatcgataggacgccctttaccgggacgcttgaatatcgtgataagcagtcagccagcacgtgatgatagtgtcacttgggttcgcactatcgaagaggctttggccgcagcgggtgatgttgatgaaattatggtaatggggggaggcaaaatttatgagcagtttattcctctggctcaccgtatgtatctgactcacattgatgcggaagtcattggtgacacccatttccccgattacgcacccgatgagtggaattcagtctttaccgaatatcatgatgcagacgagcacaactcacatggctattgcttcgaaattctagaacgccgtgaatgagcggcagcagtaaaaaacaatcacaaaaaacagttgtagtcagcacaacaaatcaaatttcatctacggagtgtcgcaaggcactccggcgtcacaggttttattccgtaggctcattaacgatttagcaatgatgattggctgaaatactgcttatcttcccaacgcatcattgtcaatttacctccccaacagcagcccgtatccagcgcatagatgccggcaggcgtacctttgccctccagtgcagcccagtgaccgaatgcaacagaatattcttcagggatgttacacggcaattcaaaccagggttttagtggggcagaaacattttcgggtttagatttgcagatcatatccagctgaccatttggaaagcagtaacgcattcgtgtcagtgcattagtgctataacgcaatctagcaagcccgctcagttcgggatcccagttattgggcatatcaccgtacatagcatcgagaaataaaggatagctgtcactgcggagaatggcttccacttcacgggcacatattctggcggtgtctagatcccattggggtgctaatcctgcatgtgccatgaccagttttagttcatcatcaatctgtagcattggctgctttcttagccaattaattaaatcatcaacatccggtgctgagagtaatttatccagttggtctttcggcttattacggctgattttggcgtaaacggccagtaaatgaaggtcatggttgcccaagaccagtttaaccgctgggccgagttgcttgataaagcgaagcacttccagcgaataagggccacgggcgaccagatcgcccgtgagccataatgtatctttgctgggatgaaaagaaacttgttgtaataaagcgcgaaattcatgatagcagccgtgaatatcgccaataaggtatgtagccatagttaatttatcagtgttggaatagccagtctgaacaccggaatggcgacacgaaatggacgcccatcatgatcacgcatttcataatggccttccattgtgcctaaaggcgtttccagaatagtcccgctgctgtagcgataatctgttccaggaaggataacgggttgttttcctacaaccccttctccctgaacttctgttcggtgtccatcactgttggttatacgccaataacggctgataagttgcacgggggaatgcccaagattgtgaattgatattgtataagcaaacacaaaacgctgatgctctggttctgattggctttctacgtaagtactctgtacttggatatgaattcttggttcgttgagcataaatgcctcctgttactgtaatggctgtttattgatttcgggcagtttttgcttgagatgataaccaacttgccatcttacagtattgctcgacagaaatgttttcagcccgtgtgcccggatcaacgcccagttcagataattgctcaactgaaaagagatcgccaaggctattgcggatagttttgcgccgttggttaaatgcctgagtagtcactcgggctaacatgcgaatgtctttaaccggataaggcatagctttgtgcggcataagacgcacaatggctgaatccactttgggggctggcgtaaatgccgtaggtggtacttcaagaacagggataacctgacagtaatattgtgccattacactcaaacgcccgtaggctttacagccaggcccagcgaccagacggttcaccacttctttttgcagcataaaactcatatcagcgatagcatcagcatagctgaaaagatggaacatcaatggcgtagagatgttataaggcaaattaccaaatacacgcagggattgtccctgatccttggccagttggccaaaatcaacggtcatcgcatcctgctgaatgatagtcagcttatcttttagcttaggatgaacatgcagacgagctgccagatcacggtcaagttcgacgacagtcattttatccatgcgttcacccactggctcggtcagtgcacccagaccagggcctatttccacgatagcctgaccaggctgtgggttcatcgcatcgacaatactttcaatgataaattgatcggttaaaaagttttgcccgaagcgtttacgggcgtagtgcccttgatggactttattattcattactgttttgtatcatcttaattgctaaatttaatgcggtaataaaacttcccacatctgcttggcctgtccctgccagctctagagctgtgccgtgatcgacagacgttcggataaatggcagtccgagagtgatattcacggctctgccaaaaccttgatattttaacacgggtaacccttgatcgtgatacatcgaaagtacggcatcagcatgatccaagtacttaggctggaacagggtatcggccggcagcggcccttctagccagataccttctgccctcaggctgtccaatgcgggaatgatcacgtcgatttcttcatgccccatgtgtccaccttcccctgcatgtggattcaggccacaaacatagatatgggggcggcggataccgaatttggttttcagatcatgattgagaatagtgactacttctctcagtgaatcaaacgtaattgccttgggaacatccataatcggcagatgcgttgttgccagcgccacccgtagctcttctgttgccagcatcatgacgactcttgagcattggctgtggtcagcaaaaaactcagtatgtccggtaaaaggaacccctgcctcgttgatgacacctttgtgaaccgggcctgtcaccagtgcagaaaactcgccattcagacaaccctcgcaggcttttgccagcgtttccgtgacataaataccgttttcccggttcaattcaccggcaatgacaggtgaatggagggaaacgggcagaatagtcagggttccggcggcctgtgttggggaaatgtattcaggggagtaaggttgtagttgaaggggtaggttgagttgcttggctcgtaagagcattaactcaggatcagcacatacaacgagttggataggccactctttttgtgcgagggcaatgactaaatcagggccaaccccggctggttcgccgggggtgataatgatgggtttattgttgtgcatcgctaccatctaaaactttcacataagcggaggcacgtaagtcctgcatccagttttgtgtttcttcaccgagtttacggtttaacagcaggcggtaggcattatctttctgtgccgagtctgttctgtcaaccttgcgggtatcaatcagttggattaagtgccagccgaaagtagagtgaacaggctggctgagctcaccttttttaagtttcactaaggcatcacggaaagctggcgcataagtacttggcacattccagcccagttcaccaccacgcatggctgtgcccggatcttcagaatacttctccgctgctgcattaaatgtggttttaccacttaagatttcttctctgagtttcatcagagtgctgcgggcttgatcatcggtcatgataggtgaagttttcagcagaatatggcgggcattaacttcagtggccgcaacctgtggcatattgctaccgcggatatcattaattttcaggatatggaaaccaacgccggaacggattgggccaataatctgtcccttatgcgctgactggagctgttctgcaaacagagaaggtaattcctgcaattttctccaacccatattgccgcctttcagggcctgtgtatcgccggaataggtgatagccagcttaccaaaatcggcaccatttttgagctcagataaaatcttgtttatgatcgccgtcgctttttctacctgtgcttgacttggattttctcgcaatggaatcagaatgttgctgacattcaactcggtattctgattattttcgctgctaagatttttggccagcgcctcaacttcctgtggcaggatcgtgacgcggcgacgaatttcattattgcgtacttcggcaataatcatctctttgcggatctgattgcggtaggtattaaaattgagaccctcggcagtcagattttttttcaattcgtccagacccatatggttctgggcggcaatgtttgcgatggtggaatccaggacttgatcggggatagtgatctgcatctgttttgccatttgcaaaatgatgtcatccataattaaacgctcaaggatctggtgacgcaaggctttttcatctggtatttgctgaccagcatgttttgcactgagtttaacggattgtaattgctcgtcgacatcactttccagtacgacaccattgttgacaacggcagcaaccctattgagttcctgtggtgctgccattgcgacagtattcactgaaaacatcaatccgagaatgagtgctctccagttcttcatacgtttcccatcatatcaatcccgccttggcggggttattgtgtttacattgtgtttgcatcatgtttatcagtatcagaatgcgcgctggtaaggcagaatacctctctccagcatcttctggctacccaaactttgattgctacttaagccacgaagttcaacattgaatgaccatttgttgtcatattcactgctgttgtccttccagctgacgattttacgttcataaccgacactcaccgcccagcagcaagtgttgtattggaggccaaccagctggcttgccggctgtttctctttggtatcgtaataatacgaacctacgaacgcccaacgatccgccagcggccagcttgccactagcccgacctgcgaaatgccctgctggaatgacggcgcttggcttccaagcgtagcctgaatatagtcgcggttaacaaaacgataattcaactgtaccagacgttcagcatcacggcgatattccagcaccgtattgcccattgccacactgttcagacgggtatcgtattgcataccccctttaaatccccatgaatcattgattttccactcaacatctccggcccatgttgtcgtacctgtactttttttggttgagtctttgaggtcagtatcttgggtacgcggactttcaaagtagtagatttgacctacggataggttaaaacgttcaactaaatcttcatcataaatgcgggtggtgatgccactggtaaactgattagcagatgaaatgcgatccagcccactgaagaagcgatcccggaacaatccggaatagttagcctgcaatagggaagaatcgaagttgttgatattatcttgatttttataaggtacataaaggtactgaacccggggttccagcgtctgcgtgtaatacttgttcatatacatggcgcgctcaaacaccattttcgcatcggatttaaacagtggcaggacacggttgactgatttctctagcgtagagttctgtgtcgtggcaggaatatcttgctgatagtgggttgccatcaatttaaattcattattgaggcttgcccagcgattggagagcggcagattgatagtcggttccacatgccaacgtgttgcctctgggtaatctttgcctacgctggtgaacttggcaatttgagcgtgggttcggaaatcaaacggccccagatcatttttgtagtaattcagatcaagttgaggctctgcacggtaagcttttctattttttccggcagtaaagatctggaattgcttgcttgccaaggttgcatcccagttctgttgggcatagccaatactgaatttctgggtggcataaccgtcggtactggtgccgtattgcgaggtaaaatcagtgaaatatttgggatcactaactttggtgtaatcggcactgaaacgccatgcttgattgagtacgccactgtggttccagtagaataaccagcggttattgctctcccgatctgacagatttttatcaagttttttatcatctgcatacaggcgatcatgaccaagccaatcaaaagctactgtacccgccccggcttttgttaaataacggaactcgttatccagcttaagaccccgtttactgatcagatttggcgtaatggtggcatcgtaattgggggcaatattccagtaatacggcagcttgaattgaaagccttctttattggagtagctggcattggggatcagaaaaccagaacggcgtttgtcaccaatggggagttgcaggtatgggctgtaaaataccggcacgttggccaccctgaaacgggcattccagatctcagcgacttcttctttacggtcgaggataacttcggagccaacaacgctccagctatcgttgcccggcagacatgaggtaaatatcccattattcataatggtatagcggttttcatcgcgcaccatcaacttatctgcgctaccgcgcccctgacggccaaccatttggtatttgccgtgttccatgtccgtatctttattgttcaggttagaccaggcacgaggccccttcaaaataatctgagggtcatcatagttaacattgcctgttgcggtcacggtcctgacaggaacttcatcttgtgtttgttcgagccgcactttatcggctgtcagcgttttattcccctgtcgaatatcaacattgccgacaaattcgaccgcattgggatattcaccgtgtgtatcatcagacttaatgttaacgggaatttggttgggatcagccgtgataatgggtttatcgtatacaggtacgcccagcatacactgtgctgcaaggtcagcatgtgcttgctgactgtaaattgctgcccataccattgtggccagcagagtgggataacatttattcatatatagttatgcggttccgtcatcagtggcatcatgccggcaaacgctcagagactaacgcacttgataaatatgcgccagagtaaagttaaactttactaatcttgctgttaggcacggagcttaatgaatagtatgataatgcaaaattgcgctcagggcattgaggaattgaagagtatatgcagtattggggaaaattatttggattgatatttggtattgcttctggtgctggcttttggggcatagtgattggcctgttgctcggtcatgtacttgataaagtcaggatgcgcaatcaaagactttctgacaaaggcccaacccggcaggcactgttttttcgcagtacctttcaggtcttggggcatttgaccaaagcaaaaggccgggtgacagaaacggatatccagctcgccagccagttgatggataggatgcagttacatggtgatgcaagggttgccgcacagcaggcgtttcgtgagggtaagcagctccggtttcctctgcgtgaaacacttcggcaattgcgacgtgcctgttttgggcgttttgacctgattcggatgtttttggaaattcagttacaggctgcgttttcagatggcgaactgcatcctaatgaaagaatagtgttgtttgttattgctgaagaactgggtatttctcgtcctcaatttgaacaattcctcgccatgatggaaggtggccgccattttggtgggcaatatcagcagcatggccgttatcaggagcatgggcagccgcgggcgactctggcagatgcctgcaaggtgctgggtgttaaggaacatgacgaggcgacagtcattaagcgggcttatcgaaaactgatgagtgaacaccatcccgataaactggtggcaaaaggcttaccgccagaaatgatggatattgccaaacagaaagcacagtccatccaatccgcttatgatttaattaaaaaagaaaaaggttttaaataacacctgtcaaaaatcggccttgcattcaaaatgcatcggagtgccgtaggccgggtgagtaatcgacaactcttgtgcatgtaattgcaggcgaggtgccagttctcttgcctgctgatgagcatagaacctgtcccccagaatggggttgccaagcgccagcatatgtacacgtagctgatgggatcgcccagtgatgggagcaagcctgacgcgagtggcctgagcttcatattccagcacttgatactctgtctgtgccgattttccggtttcaaaacagaccttttgcttcgggcggttcggccagtcgcagatcagtggtaaatctaccagacctttttcccgttctaattttccccatacccgggcgatatagacttttttcggctcacgttcacgaaactgacgttttagctcacgttcagccgctttggtcagtgcaacaaccatgacaccactggttgccatatctagtcgatgaacagattcagccgttggaaactcggcctgtatccgcgtcatgatactgtccttatggtcctctgctttgcccggtacagaaagcaactcactgggtttattaacgaccataatgtgctcgtcttgataaagcacgtgtaaccagggatcagtcgggggattataagattccagcatagtagctccagttgggtcgaaaaaatgacggggcagattttatcagcatatgatttacggtgtgagattaaaatacaggggcatctcatcgagatcgccccgtatttcaggattggctatttattagtggctatttattgatgagagaccaccaccaggcgaatggcatccagacgccaatttgcctgatcaagattgagcagcagatgcttatgttcagagtcaaccgcttccagctcatcatcacggatatttgggttaaccgctttcagcgcttccagccgtgacaactcagcagacagcacgttatctgcctcttttttcgctttttcaatcacctcacgggcttgttgttccaccagcggttcagattgctgcaaaatagcgtgaacttctttttgcaccgcgctgaccagtttactggcattatggcgattgatggcatttagctggcggttgaaactttcaaattccacttgaggtgccagattggttcctttcagatccattaagaggcgcactggtgttggtggcaggaagcgggttaattgcaggtgtttcggcgcttgggcttcaacaacgtaaattaactcaaccaacagcgttccgactggcagtgctttgtttttcagaatggaaacggcacagcttccggtatctccagacaaaatcagatctaagccgttacggatgatcgggtgttcccagctcaggaattgggtatcttcgcgggacaaggctttttcacgatcaaacgtaattgagcaaccgtctgccggtaagccagggaaatccggcaccagcatatgatcggatggattcagggtaataatattgtcgctgcgatcttcctgattaatgccaatgatatcgaacaaattcagagcaaaactcaccagatctgtatcgttatcctgtgcggcgatggtttctgccagcttttgtccctgctcgccaccattggaattcatttccagcagacggtcacggccttgctccagctcctgcctgagttgctcatgatgctcacgacactcagcaatgaatggcgtgaagccagcctgttcgtttggcttggcaaggaaattcaccagagtttcataatatttgtcatagatggggcgaccggttgggcaggtctgttcaaaggcattcagaccttcgtgataccagcgcaggagaatcgattgcgcggtattttccagataaggtatgctgatcttgatattccggctttggccgatacgatctaagcgaccaatgcgttgttccagcaaatctgggttgaaaggcagatcaaacatgacaagctggttagcaaactggaagttacgcccttcagaaccaatttcagaacagagcagcacttgcgctccttcatcttcggaagcgaaataagctgcggcacggtcgcgttctaacagagataacccttcgtggaacacggcactgcggataccttcacgttcgcgtagcacctgctccagttgcagggcagtttctgccttggcacagatcaccagcactttttcatcacggtttgccagcagaaaaccaagcagccattccacacggggatcgaagttccaccatgtcgcattttcgccctcaaactcctgatagatccgctccgggtagagcatatccttagcgcgcgcttctacggattttttggcacccatgatttcagacactttgattgccgtctgatattgagcgggtaatggtagcttgatttcgtgcagttcacggtgtggaaagcctttgacgccgctgcgggtattacggaacagcaggcggctggtaccgtggcgatccatcaacatagcgatcagttcacggcgggacttttcactctcttcatcctgatgactgtttgccgctttcagcaaaggttcaatatcctgctcgctaatcagttcgacaatcaggttctgctggtcattgttcagtgtttcgccagacagcagcagggtgacggcatcagcgaccggacggtacgtctgctgttcatcaataaacgcctgataatcgtggaaacgattgggatcgagcagacgcagacgggcaaaatggctttcctgtcctaattgctcgggtgttgctgtcagcagcagcacggatgggatctgctcggctaactcttcaatgacctgatattcgcgacttggtgctttttcgctccattccagatgatgagcctcatcgacgaccattaaatcccagctcgcttccagcagatgttcaaaacgctgtttattacggcgaacaaaatccagagaacagataatcaactgctctgtttcaaatggattatcgctatcgtgcagggcttcggaataacgaccatcatcaaacagggaaaagcgcaggttgaaacggcgtagcatttctaccagccattggtgctggaggctttccggcacgatgaccagcacacgttcagcacgaccggccatgagttgctggtgaataaccatgccagcttcgatggttttacctaatccgacttcgtcggccagcagcacacggggagcgtggcgtttgccgacttcattggcaatatgcaactggtgagggattaagctggcgcgaatgccacgcagcccactttcagccagacgaaattgctcactttgatgtttacgggcgcggaaacgcagcgcaaagcgatccattcggtcaatctgaccggcaaacagacgatcctggggcttattaaacgtcagcttactatccagaaaaacttctcgcagggtgatattttcctcttcagtatccagacgagtaccgatatagattaacaggccattatcttgctgaacttcatcgaccttgagtttccagccttcatgactggtcagggtatcgcccgcattaaacataacgcgggtaatgggtgaatcattgcgtgcgtaaaggcggttttctccgctggcagggaaaagtaacgtcaccatgcgcgtatcaagcgctacgactgttcctaatccaagttcgctttctgtatcgcttatccagcgttgaccaagggtaaatggcataaattttggctcagttttctgttagacaatgttatttatggttgcaggatggctgcttttgttggatatcgatcatcattggttatcgatagggatagttttcaacgacacttttcatcgctcgttttttggaaacgaggtcgtaaaagcaccattgcccattagaggggcgatatgttaattcaagaggagcaagccgtcacctgcaaaagtatccattattcgaaagatatgctcatctgccctgtcagcagggtcataaagttatcttgaataaatggcaggatggcgtctgcaatcggcatcagctgtttattaatgtagtgttcgtaatccggcagcgtggtctggttttccagtggctcaggccctgattgcgtgatgaggtagctgatccaaccgacattttggtattgcaatgggcgattattctgctggttatactcatccgccagacgtgctgcccggacatgaggtggtacattacgctggtaatcagacagtttgcgacgtagctgtttgcggtaaatgagacggtcatcgaattttcctgccagcgtgtcggcaatgtaatcacggatataatcttggtaaggcttctggtgaaaaataagggtgtacagttcattctggaaaatttgtgcaagcggtgtccaatccgttcttattgtttccagccctttgaaaatcatcttatcgccactcaatccggcatagcgttttttactgccttgttcagtgcctctcacggttggcatgagaaaacggcgataatgggtttcaaattccagttccagtgtgctttcaagattgaactgcgttttgagatggctttgccaccattgattgacaaattgcgccagcgaatgacctatttgactggcttctgcttcagaatgagggtgcttcagccagataaaagttgagtccgtatcgccataaatcacctgatacccttgtgactcaatcaactcacgggtctggtgcatgatttggtgcccgcgcagggtaatagaggacgtcaggcgggggtcaaaaaagtggcagcctgacgcccccagtacgccataaaacgcattcatgataattttcagagcttgggagagcggggcgttttgttgctttttggctttgtcacgttcatgccagatttgcgtgatgatatcaggtaaacaatgttgagtgcgagagaaaaacgcttgccgaaaaccgggtatggcatgttcactatcgggctgggcgaggccttctaccatgcccacgggatcgatcagaaaagtgcgaataatagaaggatagaggctcttataatccaaaaccagcactgaatcatacagccccggaaacgaatccatcacaaaaccaccggggctatcaccggagtcagttgcatgaacgggagagacatagccgatgcggtgcattctcggcagataaaggtgtgtgaacgcggcgactgatcctccgctgcgatccactgccaatcctgtcaccgtagcgcgctccagcaggaacgtcatcaaatccgtcttatcaaaaatgcggttgacgagaatacagtcctgcaaattatagtgggcgagagcaggtttatcctcctgaaagcggcgattgatttcatccatccgatcataggggctatcaatggcttttccttcccccaataacgcctgtgcgacatattcaagactgaacgaaggaaaattccacgttgcggttttcagtgcatcaatgccatcaataatcaggcggccttcagccgaggcgaaaaaatgccccggcttgaaaccgtgctcccgccattccagcaaaccatgacgacgaccgagtttcagcggtacgttatagcgttcagcatgtttctgtaatacttttaaatcaaactggatcagactccagccaataatggcatcgggatcgtaaaatgctatccattcgtttagcttttccagcatctgcggacggctggcgacgtactccagcttgaaatccctatcttgcctgctcccgttttctgaccccagcataaacactgtttgctcaccgcaacccgctaagccgatggaatacagctccccatgctggctggtttcaatatccagtgaaacccatttcagtttagggcgataggtgggattcggtttcatttgatagctgccatccggtttctgattgaaccagacgggtgcggtaataaagcgctccatcataaatcggtcaggtgggcggatatcggtttcgtagagtggaatatcctgttctttcagggtcttttccagctgttgcaattgacgatattgcaggcaatataaggcagttacgggttggcgattgaaatctttcaacggtagaggcttgagttcacaacgcggttcttggtcgatgatacgctttgccttctgcaaatcatgctggggaataaaagccaccgctttttggtgagaaatagtgatgcggcgagcaccctgatccgtcgccagccaatatactaactcaataccggatggcgtatctttccagtgacgggtgagtatgaaaccttgttcaacatgctttgtttgcataatatttctgcaactgcttttgtgttgagggcaaagagccgcctctacattgtaatgaatagtagcctaaattatagcacttgtagtggttatttatacagtggttttttaataaagtcagaatatagggtttttatgatgaaaaatgcattgaataaaaaacaatctgagttacttgccagttttaataaagaagaattacttgaaatcatccatgcattaatcagaaataatgagctggctcaaatcacattagtcagtggatatttgctggagtctgaagacattctgaaactcattgaaaaagagtataaaaaacgcagcaagagcaaacgatttttcgattattatgaaacggataccttcttcaatgaactacataactctatggcaacgcttttgaaccgggttattcctttaaaaccagtagaatcagaagtgttactgtcatatatgttacaagactttgaacgcatgagtgaaactaaagacacctccagtggtggctggcaggattattactactaccttgttgaatcttggattaaggcgttatctctgcaaaaagatactgataaggttacggtagcaaataagcttttcaagattttccaaggcgaatattatttctctttgtcccagttgggtgaatataaatctactttgggtcttgatattcttcgccagctaagagatatattttatcagcacaaaaaagatgatgaagcactggagttgagttattccattaaagatattgaattctttaaaacgtatctcgataagaagaaaggatttttatatccaagatattatctggattacgctgaattgctgattgaagatgtcagatctgatgaagctattgtgttgttggaaaatctcagagaaaaaaacaacaaactgccagttgaactcaatgatgataagataatggaattattgattaaggccaatattgaagagggcaagaaagaagaagccagacaactttgtattgacgctttcaaggagtattataaccataaattttataaattatatgaaaatactcttgataaggatgagaaagggggggctataaaattatttttggatatagccaatcaatatgaagaaaaccgtttcttttatttactattcctaatagaagtggaaagattcgacgtgatcaatgattacattttgaatttgggaaaagataatgtaataaaaattaccgattctattattcccagtacggcgagaaaagtgtcaagtttgctgtataaaagtggttttcccttttctgcgacgctcgtaagacgtgcgcttgttgaagatgtacttggtcgtggagcaagtaagtattataaatattccgtttctgatcttaagaaaagcttggattatggagaaaaaatacaaagtacggacgatatttcctctaatcaaacctatttaaccgccctctacgcaaagcataagaaaaaagtctcattctggtctttggcggaagaaaaaattaagaatgtttcgatggataacgatggcgtttattatggaaagtgaaggttagtttgagcctgcacccgatttgtgttatttccattaaaggtggctattcagatggccacctaattcagtattgttttaatgacctgtaaattaaatgtattcttttggatgacttatatcaattaattgaggaattttaacaccatttgagtggctaagagccgtgctttttagagaatcaataatacagaatatatctatattctggaacagctctataggtgtaatcttggtttttatagagatattatgctttgtgtcgatgcgggtaagcagaagctgaatcaggtaaattctctgtgctcgtgaagtggtaaaaagaatggctttgcgtcatggtgggcggggaggggcgattgtgaatgtttcatcggtggctataaggtggggtctccccatgaatatatagattatgtggcatcgaaaagggttttgatacgttgacaattgggttggctcaggaaatcgcacaagctattgcgtggctattgtctgatgctgaagagttgtgaatatgaatagccggaaagaagattaaggatatttccggcttattaatgggcatgggttcttaatctaacaattccgtcaatttgggtttaagaataatcttaccaggcgtcacttcaatattgatcggttgctccactaactgactgctcgtcagccaatcaccagcaatataaagctcaccgttttcacgaatgttgtcgataccttgatctgcatgatcttccacttcatggatcaaactaacaagatcaacatcaggatcaacgagagagataattatcccattggacaattgtgagatatgaaataacgcatccgcactaaatccagcatcgctgagtgtgctgccattaagcattaattcgggaatatcagtatggcgaaatgaaacatgaaggctcatttgtacgttccttgtgttatttaggcatattgcgatactttatcagtacttcgctgatactgcactgcgaattcatacgtgttttcaaattcatgtgtgttttgatttgtaccggatttgttgattaattctcaatatctacacactagcgcttagatgaacaatatgctatcgataatgttggtctttgcgaagtaactcgcaaaaaatgactgtatatttatccatgctgacatacttgactgatttaaaaaataaaaatagaagataagactattaaaggctcaacaagatgaaattatctagagaatgtctcgattaaaataaaaacaaataaattgagttttatcattatttcaattttttattctttagattgtgaattagccttttttgaatttttcagaaaaatgtattttttcattgtgattgaatatgattatggtgtttttatttattattattaatactatactttaaacacagatttgtttttatccaaaataattctgatgtatcatatgtttaagggaattataggcagggaaatatcattgttgtataagtatatattgtttaggttaattagttttaggttaatatatgagttgtcatttggtgttatttataagttttttttggtcgtgacatcaatttattgaattatgtatagtctgcctatttggagaacattcaaatggcaaagattgatgtgacttgcccctcttgttgctcagttaaagggatctatcgcaacgggcgctcacgttctggtcattcgtcatttaaaaaactcaaacccaaatcggtaacagaagccattaaacttggcaccgaagtgattgtctgctgtgaaagggatgaacaatggtcgtacgtaaaatcaaagaagccgcctcgttggcttttttatgccgacgacaggataagacgaaaagtgatcgcccatgtttttggtcccagaacaaaaaagacattaatgcgcctactggctttgctgactcctttcaatattattatttatatgacggatagttggcaaagttatgaaaaggcgttagcggggaaactgcatgtggcctgcaagcgttatacccaacgcatagagaggcataacctgaatcttcgacagcatttggcaagactgactcgcaagacattgtctttttcaaaatccatagaaatgcatggcagaattatagggtattatctgaacattcatcacgatcaataaattggagttatgatccgttgctccccaagccccataaatgcatctgtttattgttgagttgtaaggatagattacaagtatccgataacgataaatgttcaatttaaagggaaaaaatggtcacgtattcaaagtgtgtattgtgattttcattgtatgcatctaatgctgattaatgcatataaattgcagaaaaactttaatggtagagttgtactgcaatcacagctttcaacacattaaatacatgaccaatatattaacaccaaaacactaacttaacattttttatatttataacaaccatttacaatgtgccatacactactttcacttgggtcaagatacaaatatgttccattctgtttcgtaaaacccattttcaaatatgctggcacagcgtctggcaatggataaagcattagttttccacccatatttaactgttgggattcgtttactgcttgttccattagaataataccacaatttctaataccacaatgggttactatatactcgacttcaggtaatttaggaaaaattaaattagactcagataagtttttaagactcaattgtagtccccctatgggaacactaccaaaataaacaataaaaaataatctatcatcgtttgatttggcttttttcatataatcttcagcatgatcctttatattatgaaaaatatgatgtgaattcatatatctttctctccattttttctggttaacatcatgttgaacatcaagctggtcatgaaaatcacaaaaactccattcctccatcatgttttttgttaatattatatcaattgctttaactgcttcttctgcactaactttttttactgtgatcaacgtattgacactgtaaacagttttttcaatattcgaagtggattgagagagaggcaacgaattaaatgacaaggatcgattaataaaagattttgatctgaacatcgcttttttctccatataaatataattaatatttctttgcggtatagaaaagtttaatttacattccttactgtttaataaattagatatatttaattgatttataatcttgcctggcgtattcactactcagtctggaagatatcttattttacttatactcccttttcatccatatataaatcaaaaataggtcgtgacatcaatttattgaattatgtatagtctgcctatttggagaacattcaaatggcaaagattgatgtgacttgcccctcttgttgttcagttaaagggatctatcgcaacgggcgctcacgttctggtcattcgtcatttaaaaaactcaaacccaaatcggtaaagaagccattaaacccgtcaccgaagtgattgtctgctgtgaaagggatgaacaatggtcgtacgtaaagtcaaagaagccgcctcgttggcttttttatgccgacgacaggataagacgaaaagtgatcgcccatgtttttggtcccagaacaaaaaagacattaatgcgccatcttcgacagcatttggcaagactgactcgcaagacattgtctttttcaaaatccatagaaatgcatggcagaattatagggtattatctgaacattcatcacgatcaataaattggagtcatgacccatttcgtatcgagattaaaaccgattgataacgataaataatcagaaagcgatagctttatttgatgtcttggaaatacaactcagaatgctggctaaatgtagtctgctgttattatttttttcgctgtaataatattgtcatatatatgaaataaagttgtaatataaatgtaattaaatatagcttctttaatatcattttctctgtattgagcctattttgtggattttatatgtcttttttattagaaaaataccattcttatatttttaaaagggtgatttgatagtctctgaatatcaatggataatttaaatctattgatcgtatattttatttatcgcattattcaagtataggaatatatcttctcgatatttttccttgtaatctgacaatgaaaattaagttaattgtatgagatttaattttgttatcaatttttcatatgttctattatgggaatgttattatggttttttatttatataaaaataattactcggttgactatttattattggtgcttatgttgataattatactttatgaatatatttcacaaaggaaattattatttaaaatgattcttttaactgaaatgtgttgttttatgaatgctttaatttataagaaaaataattaactacctatcaaaaagaataatatataatgctaaaacgtaaatatttaacccattctgaaattgaacagctattagctgaattggaaaaagggccaaatgcagagcgtaatatctgcatgttttttatgggtttcattcacggttttcgagtttctgagcttttgaggcttcgaatgtctgatgtggatctacgtgaccgtagtttgagtgttaaccgtttgaaaaatggcttttctactatccatcccatgattgccagagaaattcaactaatacgtaaatggatgacaattagaaagaaacttgaaaaatttggtaagagtgaatggctttttatttcccgaaccggggagccgttatcacgtcagcaattctataaaattattagaaatacaagtatcaaggcagaaattgcgatttgcgcgaatcctcacatgttgcgtcattcgtgtggttatgcactagcagataatggtgtcgatacacgattgattcaagattatttaggccatcgcaatattcgtcatacagtcatatataccgcgagtaacgcaggtcgctttgatggaatttggagagcaagagggaagagaagaagggtgatatttagtaccaagctgttaactgccgatgaattttctggttcagagttgtcctgaacattgcctttgaataatcatgtttatcagtaataacttgctaaaaaaccccgccgatattaccaagcagggttttttaatcatagtggaactacattaaatggttatgccgtgctgaatagcaagggcagagaggcctccggcaaaaccctggcctacggctttgaatttccactctgtattgtggcgatacagttcaccgaaaatcatggctgtttccgttgacgcatcttcagacaggtcgaaacgggcaatttcctgatcgttgtcgttgttgactacgcggataaagctgttgcttaccataccgaaattctgtttgttgttgtctgcgtcataaatagtgactgcaaacaccatttttttcacgtcagcaggcactttcgccagatcgattttaatctgttcgtcatcgccggcgccttcacccgtacggttatccccttgatggttgactgagccacaagggctgactttattgttgaagaagacaaagtggccgtctgacagaactttgccatcttccccaaccatgaaaactgaggcatcaagatcgaatgccgctccgtcagtggcacgcatatcccagccaagacccaccagcgcaatattcatcgcaggggcttcttttgtcagtgatacattgccgcctttaaccagagatacacccatttttactctccaaatagtattttaaagtatcgggcaggcacacctgcccgatcatgaattaagtgatagctgaatgatcaggaagcgttaatgccgtactgagcgcaaacagatgccagaccacccgcataaccttgaccaactgcacggaatttccactctgtattgtggcgatacagttcaccgaacagcatggccgtttccgttgaagcatcttcagtcaggtcgtagcgggcaacttcaacctgagtatcatcgttaaccaatcggatgaaggcaccggaaacttgtccgaagctctgatgacgggtttgtgcgtcatggatagtcacaacaaacaccactttttccacatcggccggaacctgatccagtttgattttcagtgattcatcatcgccatctccctcaccggtacggttgtcgccagtgtgcatgatggaaccatcagcagatttcaggttattgtagaaaatgaaatcggcatcaccacgtactttgccgtttgctgacagcagaaatgcagaagcatcaaggtcaaaatcttgtccatcggtggcacgggcatcccagccaagaccgatcagaacatttttcattgttggcgcttctttgctcagagaaacgttaccgcctttagaaagagatacacccattattatttcctcacttattaagtcgcatacccttattttttaagttgctgctttgtgggcggcagcttgaaatctatttgggtatattgattgatcgtattaattttaattgcaggatttaactttcattttcttctttttggggaaacagcaggctgacaataataccgacagtcagtactccaatcaccacgaacaagctggttgtcgccgaaattgaataaccgtggtggaacatatgttcagatgcgttcaggccgagtttgatggcaataaagaacagcaggacgataaccgctttttccaagtgaaccagatactttttcagtgcttcaagcacgaagtaaagtgtacgcaggcctaagatagcaaacatcatggcactgtaaacgattaaaggttcccgactgacagcaataaccgcaggtacagagtcaaaggcaaacatcacatcggacagttccactaccgccagacataacatcagtggtgtggcgtaaagcgccgctttgcccgtacgacccacttttacatctgcgttttccggtttggtgagttcggcattcacttccttttgattcaacatgaaagcgtggccgcgcagtttgggccagatagggaaaaagcgttttatcagacggtaggcaaggtgctgtgaataatcctcgatttcatcaccgtcatcaccgcttttcagcatcataaccgcagtccagcccacgataacggcaaaaaccatttcgacccaagggccgagcgtcagcaggcttgtcccgatagcgacaaagatgccacggaagacgattgcaccgataatgccccagtaaaggacacgatggcggtagcgatcaggaacggcgaaccaggagaaaatcgccatgatgacaaacagattatcgacagacagcactttttccagtgcataaccggtaacaaacaggctcgcggtttcagcaccgtgatgaacaaacaggaatccggcgaaaacaaaggcaatagcgatccagaaaatggaccagagggcagcgctgcgcagcgaaatcggcttatcatgacgatgcataaagaggtcgataaagagcgcgccaaccgacagaataatgaatacagcaacggtttccatcggaaaacctatgtgcgtggataccatgaagtgagcctcttaaagttatctgcgattacagttcgaaatctgcgggtgtaaagcccagagttgtacaaatttcacgggcagccgttttttcgtcgttatcaaaatcgccgtcacttttggcgacggcaatacctacgcgcaaggcaagctgtgccgcttccggctgcggtttcagaatcatgatgaatttcatggcttcacctttgccaatgtcagcatcaaattcatagctgctgaccagtttgttgaagaattcaataatttcagtggtatcgaagactttcagttcaggggagtttttgatgaaccctaccattttctgtttttcttctgagctgacgccgttacttgccatcgcaatgtgtgcgcacacggctacggtgccttccatgaacttgcggttcttgaagcggccgacctgattggtcagctcttcacggcccgcgctgaaagccgtcttgattttgtttaaaaaggacatagttctctccgattgtctaaaatgtgaaggattatttactgcctgcgacccagcgaaagccccagccgaatgctcggtccatctccttatgcccgctgaagtactgattgatacgttctactttgattgcaccgttttcattgacaaggcggccgaccgcacacatacgtttctggttattgccttccgtcatgcgggtttcgataggggcttggccactgatatgaattgtgaccacgccgtctgtattgtcccaactgggaacgccttcatagatcaaggcataaactaacacttcactgatgtttttccattcgagcccattaatgtggagccattcaccatcacggacggcaccagttcgatcatcaccctgcaattttacgtagggttcccgatgataatccccaaagcttttgcctatcgcctgcacgacataacgttctccgtcatgcagccgaatgaatgcgccgagatccagatccacgcctttgttggcgctgaatatgccctgcaatacccctttttttgccggagaagcagcctgattccagttcaggttgacgcgaatttcaccgaaattgtcacgtttgctcaggctaatcgccggtttttctttggtgagcgaaaccttgcttaaattgacgctatttggtgctggagtgggagcagggggtggtacaggcgttttagctggcgcatcatcaacgatattcacaccaaaatgctccgccagtggtttaaggccaccattaaaaccctgagcaataaagcggaatttccattcattgttgcggcgatataattcaccgaggatcaaagcggattctgtccgaccctgaacgtcaacactgccctgcagaacgatgcttccgttcagttctacctgaatagaaagagtccgcaggctggaaatggtctggttgccgtcgcaggtcactgtaaacgccactttttggacatcgtgacgcagggtaggcaggttaacaaagaacgaggtattaacgttcccccctgcctgacggatggtgttgtcatcattgaccggctggccataaaacaccatgtcgggatcgccctgaactttgccatcggcgtacaggcggaaggcggatacatccacggccgtgcctgaaagtactctcaccgtaagagtctggttggatacgggggcatttcccccgggggtcaggttcattagcgcaccaccgtctcaacgatttggggatacatatcgtcaatagtacgcccgcgacaagcggcaccatgtgccgtgaaatcccattgacccctattgcggcgcagggaagagatgataatgccggtgtgggcgccctgctcatccaattggtagcgagccagctctttgccgctttggtcaacgacacggcagaaggcattttcaacatcattaaaggtttgaccacggaaactgttaacggtaaaaacgagatattcgacactggcaggcagtttgatcagatcgacactgatggtttcatcatcgccgctgccttcaccggttctgttatcgccactgtgtgccacggaaccacatagtgagtccagttgaccaaaccacactgtgtcgatagtcttgccagcgttatcgagcagtatgcagctggcatccagatcaatttcgtcattgccaccgccgaacatacgagacagaaagcctttgttcttggagacaggatcccaccctagaccaaaatcaactttagccagtgaagcgctctgcttggcgagcgaaattgactgatttttgcttaacgaaatcattaataacacctctttttttgtcggtgaatcgtgataattctacttatggaaaaaatcataatatgacaaaaatgtggctaaattctgtcatattatgattcctgcaatcagtaaatattgttgttaagtctatgatagaaaacaatctgatttctttttttatgatttcttttccaagaccaaaagtcaaacaaattttgtgataaaaaatcatattatgattgacacgtacttccccccagttctagactgcggcgcatatttcgcctgagctggaaaaattattgaaagtgaccattttgaccagcgacagttcaatcattgcttccgaatgaataataaaattaggttgatgaaaggatcgttattgtttcccatcagtcatctcagacgggtagaaattttttaaaaggctccctatgacagcatttaatgatacgcagagttatcaaggccagatttccaaatggaagttgaacagcgggacgttgactgtaacggcagcccgtggcaccgcatctctggaaaccctgtttgatattgctgaacgccgtaaccccaaaagggcatttttatttgtcagcaaggtattgggacgccacattccggtcagtccatcgatcatgcgctcggtttaccggcagttatctgaacaatttccgacccacattcccggccctgtgctgtatatcggtatggctgaaacggcagttgggctggcagccggggtttttcaagaaacccggaaacaggctgaagctccggtatttttgacgtcgacacgtcatcccgttgagggtgacctgctgtgtgaatttaaagaaaatcacagtcatgccacggatcatctgatttactggccggaagaaaacagattgcgccaacgggtggttaatgcccgtacccttgttctgatcgatgatgaagcgaccacgggaaatactttccttaatttactcaatgcactgagtcatgccggccttaatcagattgaacatatcgtcaccgtgacgttaacagattggagtggcaaatctgttatagaacgttgtcctctgccagtctctacggttgctctgatcgagggaaactggcattgggatgcagatatttccgccccgatccccgtcatgccgcaagtcaatgtcacggcgcggggagatgccggcattattggtaagcagagttggggacggctcggattggatgacattcagtgtgatatcggcaccgaaattcatgctaaagcgggtgaaaaagtgctggtgctgggttccagtgagtttgtctggcagccatttttgctggctgaacggctggagcaggaaggcgcacaggtgaagtttggttccacaacccgctctcccatttcctgcggccatgccattcagtcagtgatgtcttttacggataattacggattggggatcccgaattttctctacaatgtggcacatcagcaatttgatcgcatactgctctgccttgaaacgcctaaaaccgccgtcgatccggcactgatgacgcaacttgcccgtgtttccccgattgtcgagattgtctcctatgattaagcccgtttttttgactgatcttgatgacacgttatttcaaacgcgtcggaagataaaaaaagcaccggatattgagtcttgtcgtgtgggcgcattggatcggaaatattctccttgcagctatatgaccgaagagcagtcaatattgattgactggttgctggcttatgcggaggttatccctgtgacggccagaaatacagagcaacttagccgggtgaaaatccctttcaattcatggcggattgcggcacatggcgcagtgctcttgacgccagaaagtacgctggatcaggagtggcaggcacatattctggcagaactgacgccttaccgtgatcagtttcgggaactggagcacttgagtcatcgcttgattgctgctcatggtatagaagcatgggcgcggattgattatgaatatggcgatgttcccgtctatctggtgattaagcacagagactgtaatcggttggaaggccttgatgtgcttgctgaaaatattacccaagaaatggctgatgtttttgattctggtaatttttatcttcatcaaaataataacaacctgactttgctgccaaagtgcattgacaagggattggcaacccgtcaccttttgacaaggcttcgtactgagagaggcgtttttcctatcattggtctgggggatagcctgagtgaccaccgtttcatgaaactgtgtaattggttcggtatgccccagcacagccagtttgctaacaccttgatgacctctttattcggaactgtaaataatgaatagctttccccttttttctggttcatatgctcctgacgatgtccagtttctgctaaaacccgtccagattgagatgacaccggttgatatcaaagagcagcttattcagtctggcgttcgtcactattcagagatgttgagtcaagagccagagccaacaccttatcatcttgatttatttgacagagcgcttgaacaaggtgcaattcgtctggcgaccgaagtggtgatgctcgccaatgcgttgatatcacgctttggtgatacgccgatagtgttggtgagtctggtcagagcaggggttcctctgggggtgatgttgcaccagacactcagaaaaatgggcaggcaatcttatcactatggcatcagcattatacgggatcgcggtatcgacagtacggcgctgtcgtatattgagcagcaacatggcacggatgggctggtgtttgtggatggctggacaggtaagggcgcaattatggctgaattatcccgttctctggcgggtcggtctggctattcaggcatcccccgtctggtggtactggccgatccttgtggatgttcatggctggcggccagtgatgatgattggctcattccctttggcattatgggagcgcctgtatcgggtctgatatcacgttcgatctggcgtgaggaaggaatgcacggctgtgtgcaatgtgaccacctgagtgagtttgaatgtagtcgtctgctggtggataccgttgctgattgtcgcgatcgcttggatctgggtacgataccggtggtggattggcagccgcaggaaaagatatctttgctggaattgagcaaaaccgtgatctcaacccttaccgaagtgtaccgggtcgacagcattaatcgcatcaagccgggcattgcagaagcgacccgtgcggtattgcggcgcgttccggaacatgtactggttcgatctcaatatgatcctgatgttgctctgctggttcatctggcacgtcagaaaaacgtcgttattactgaagtcggcgatctgataggacaatatcgcgccgtgactatcattaagaaggtagcttgatgaaaccgatcccttccccacatcaacttggtgcaacgctgtacattccggccactcgtcaaggtattgcagaaattgtactacacaataaaattcccggtctgcgttctctggtgatctgcctggaagatgccgtcagtgatcaggatattcccgccgctattgagaatcttgacggtgtactacaatcactggcgggagctgatatctcttcttcccatacagagcgtgactaccccctgatttttatccgcccccgcaatgaagagatgggacgttatctggtagacaacgttaacctcagcgccgttgatgggctggttctgccgaaatttacccgcgcttcattagctggctggtggaatatcgtgggttcgacccatctcagcatgatgccaacgctggaaaccgaagaagtctttgattcccggcagctgaatcagctagcggacagtcttaaagcccatccctgttataagcgtattatcgccctgcgcattggcggcaatgatctgatgaacgtgatatccctgcggcgttcgcgtgacttcaccttatatgaggggccaatgggatatgtgataaaaatgctggtgactatttttgctgcgcggggtttctccctgactgcacctgtttgcgagcatatcgatgatttgcggttgcttgagaaagaactggtattggatattgctcatggtcttgtggggaaaacggccatccatccggggcagattgaatatatccagcgggcgttgatggtcaatgggcatgattatgcggatgctctgcgtatcctcaattccagtcaggctgtattcaagtctcagggaacgatgtgtgagcctgctacccatcgacgttgggctgtgaatatcctcgaccgggcgaaatactatggtattgcgcctgaattcaatgaagaaagctgtaaaacttttaatttgttttgatattgatttacttgtggtaggagctatgctggacgctatgcctatgattaacattagggattttttgtttagttatccccgatttggtaatttaaacgatgttacttagccccaagcaatttagaaatttcaggttgaccttattactctcgcatgagaaacccgttagcaaagtgagaatgattcgagagctgaattgttcagaaccgacactgacccgtgcattgagggagctacgcgatctctattgtgccgatatccggttcagcaaaatggggaatacctatcaattggtcgataaaggcacactgactaaaaaagatgtgcgcagaattgaagagttgctcatccagaataatagtctcaaggccgaagaagctatcagccatgttttccttgataaggagaagaaaaagccggtttctctctccttgaggatgtccgttattcgaaaaattgacgggctggccaatcggcttgagacaacccgaagtgacgtggtcgaaatggtggtagacaggtttatggagacactacagaaagaggccatggacgtggattcgcagaaaagataaatcatcgttatgccagttgactgtgatcaactggcatcaggggaatgaggtgaggtatctgattgaaggcgcgttttagtgcttgtggcgggtaagcttatcaagatagcccataacaaatgcggacatcacaaaagtcagatggataatgacataccacatcagtttattgtccggaatatttttggcatccataaagatacgcagtaagtgaatggatgagatagcaacaattgaggccgctactttatttttgagagaagtggcatccattttccccagccagctcaatttctctttgtgttcgtagatatccagagttgaaacaaagttttcataaccagaaaacatgaccatcaccagcagcccgccaaccaacgccatatcaatcagagaaagtagtgtcaggatcaggtcggattcagcaatggaaaagatatgcggcaggatatgaataatttcctgaaagaacttaacggcaagggcaagcagtgccagtgacaaaccaaaataaactggggcaagcagccagcgggaggcatacattatgttttcgagaaagcgttccatggtgtttttgtctattaaaaaaggggcgatagtatagatcaagaatatgacagctacgaaatacatatcgcggttatctggattcgacctgtttgtacagaggtgggagtgatgactctttatgcagtcaatcgataaaatatctctgccggtgacaatgtcttatcttcgagattgcacagactcagggcataagcgaggtaccaacgaacacattgggcaatgatatcgacaggataatgcagacgtttgaacgcttttcagataagggataccgctctggactcgctcaaaaacaggggagcttacctgatgaccgcttaatgcgacagaacctttaatatcgtattagatcgactacttctatttattctgcgcttgatggaatttaaaataaggttaacgtagtaatggtatatggaaaaataatctttcgaaacatataccaaattaattaattttcaatgtttaaattatttcagtgttaattattttatcatctgaaaattcagcgggcatctatgaacggttccataccatggtaatttcaggctcaccggtatgttcatcaataccctgctctttttcttcaaaaccctggcttgcataaaactttcgagcgttggtatttttttcatagacatttagtgttaaagaattacggacttcaaatgcatgatttaacaattgtaacccgatccctcggttttggtactcaggaagtataaaaattgaggccagaatattgtcaagaagactaataaaaccgacgacttcgttgtttatcgtcgcgacaactgtctcagaattcggaatataaatttccttcatatccgttttacatgagtgccaaaaatcttctgatacaaatgcatgacacttaatcgaagtattgaaccaaacatcgactaccgcctgtacatcattgtcatgctcgataggtctcagttttatatcaccaaaatatttattactcatattcttctcctgttcaattttatttttttgtggtaaaaattcatttaatatattagctatacatcgcagtatctaatcctatcacgcctgcgccaataattgatattttcaatttataacttcttttaaaattatttaaatcaggatttagaaaaaattaaattattaatatcctaactaacaccgcatcggcattgtgttgtaactatggcttcacatcataaccggctcctcttctctgctgtttggtcagtttaatcaaatgggggaggtactctctcgcatcccgccaatcaccaagaacaactttcctatagaaacggtgacataagactaccatttgttaatggtaagttaaaatatatgtataaaaatggataacagattgtggcatgttattaagcatcatcggcagtgctgatgaaatgtattcaaggcagtcaatgtcgcggttttgatctttgttcaggtattcaaattatttatttaccgttttagcctgcttctgctttcagggaacgatccccgcgatggcgttaacccgtcaacgttaacacaggttacggcctgtacttagccagaaaatattagataaaactccgcggtattgtccgtggtcaactgtttttcctgtgaaaaaaccggtcgctggcggctgtcttgcacattgctcataaatgatatttttgcaaattaacaatggatggtaactgagatgaataagcgatacagaatattccagcagattccggttgctgggcgtttgtcggtcaaaaccgagtcacgtatccttttccgtgccgtggcctgctgtctggctgccgtcagcgcgagtgcatttgcggggagttataatgatcctggcaggctgaatgatcctgccagctggcgtaccagtgagttccgagctgactgggggcttggcgctattcatgctgacgaggcttatgcccgtggctataccggtaaggggatcaaactagggatattcgatcagccggtttataccaagcaccctgaatttatgagtccggataaggtgatcacccttgccacctcggggatccgtgaatataccgatccctatattaaagtgaaaaaaggggataaatttaattataatggcacaccgaccgtaggttcatccggtaagctgggggcgcacggcactcacgttggcggtactgcggccggtatccgggatggcgagaagatgcatggtgtagcctataatgcacaaatcatcagtgccgataatggtgatcctggccctgaagacggcatcatcttaggtaacgatggcggcgtgtatcaggccggctggaatgcgttgatcgggagtggcgcccgtattattaacaacagttgggcgattggtattaccaaaaaatttacactgggaggctataacccagcctatccacactttactgtagcagacgcccggaagcagtttgatgaaattaaattgattctggggacaaaaccgggtggtgcgtatcagggcgcaattgatgccgcacgtggagggattgtgacgatttttgctgccggtaacgatggcaatctgaataatccggatgccatgtctggtctggcttggtttgtcccggagatcgccccgaactggctgacggttgccagcttgcagcaggatcttaagagcactaacagtgtgccttattccatcagttatttctcctctcgatgcggctataccgccagtttatgtgtcagcgcgcccggcagtcatatctacagcgcaatcatcagtggaacgggcatggataatctgacgactggctacgctcactacgacgggacttctatggccgcccctcatgctgccgggagtattgccgtgttgatggaacgttttccgtacatggcgggggatcagatcgcatccgtgcttcgcaccaccgccaccgacatgggtgaaccgggtatcgatgcgctttacggctgggggatgattaatctcggcaaagcgatacacggccccggtatgttctataccgcagaagatattccacaggctttccgtatccctgatcccgacggtgtggcctatggcagtagccagtttattgcggatatttccggtattgggactgtactcgataaaggcaaaccgaccgagcgtatctgtgatagccagcagtgtgcgcaggatatctggagcaatgatatcagtggtcacggtggactcaccaagcaggggagcggaacgcttattcttgctggtaagaacacctattcagggccaacgttggtcagacaggggttattagatatcaacggtgaactgacctcctcagtttcggtactggagagcggtgtgctcggtggtaatggcactatcggcgcactcagcgtgcaacgcggtggtacggttgcaccgggtaactctgtcggcactctcaatgtttcccgcgacgttgcttttgaagccggttctcattacgccgttgaaatcgctgctgacggacgcagtgatcatattcaggcggctggccgtgcacagcttcgcggcggtgacgttgccgtttccctcgaaaacagtgctaatcttctttcccgcaatgaggtacgcagtttaattggtcaacagtaccgtatcctcagcgcaaaacagggcatcaacggccgttttgatcaggtagccccgaactacttcttccttggtaccagactgtcgtatcagcctgatgaggttacgctccatgtcgggcgtaataataccgcttttgcggatgtggctaaaacgccaaacgagcgcgctgtggccgcagcagcggatacactcagtgttggcaatccggtttacgagagtatcctgagttttacttctgtggatcaagctcgtcaggccttcagtcggcttgatgggcagatccattctgatattacctcctcgctggtcaatgacagccgttatctgcgtgataccctgaatactcgtctaagtcaggctgaaggccgtgcttcatcgtccgatatccgcgaagatgataatggtgcatgggcacgtctgctcggtgcgtggagtcacgcttcgggtacgaataacagtacgggttatcaggcttccacttacggtgtactgctcggatttgatgcgcctactgatgcttacagccgtctgggtatcgcgaccggctacacccgtacctcccttgatggtggctacgactccagtgctgacagcaataactaccacctcgccctctatggtgaccgtcagttcggtgatctggcactgcgtgtcggcggtggatacacttggcatcgcattgatactgctcgttccgtcagctacggcagccagttcgatagtcagagtgctaaatacagtggccgtacggcacagttgttcgcagaggctgcgtacaatctgcctgccgggtcagtgaactttgaaccattcgtgaatctcgcctatgtcggcttccgcaataatggcattaacgagaatggtgcggcagcggcgctccacggtgataaacagcacaccgaggccaagctctccacactggggctgcgtgcgaaccacagttggcaggcaatgggaggaacttcggttgctttacagggtgaattaggctggcagcatcagtatggtgatcgtgaacgggttactagtctggcgtttcgcggcagcgacaccagttttgtgacccgcagtgttccggcctctcgcgatggcttggtgctgaaggccaatgcggagatgacagccagtgataacgtgtcattgacgcttggttacagcgggttgctatccagcagccatcaggacaacagcgttcacgcaggttttaactggcggttctgataaataatgatgagtctttattgttgccgccgacataactcacgttgatcgctgtgaaaagtttttggagattccctattgtattcaggccaatgactggcctgaatacaataaatttaagatcatacttcggtatgcattcccgcatctttccagcctgagaacccttttttaaagcggcgggcgcgaacgcctttagcacgcagcaattcgagggcattggcagagagaacgcaataagggccccgacaataggcgataagttcctgaccggtagcaagctcgtccagtctgcttcccaattcatcgaccggaatattgatggcgttcggcaaatgaccttgttcaaattcctcttttggcctgacatcaagcaatgtcatgcttttttctttgatccgatccagcagttcttcccatgaaatagattcctgattatttgtatcatcaatcagcctgcgcatttctgtgcggttaaattcagcatattgcaggagtgccgagagaatatctgccagcgggccttctccctgccggtaaagaacatgcttgccttctttgcgggactgaagcagtcctacgcgcttgaggtgctgtagatgctgggaagtgttggcaacggacagaccggataaatccgacagacgttcgacggattgctcggtatcggccaaacattcaagcaatgtcaggcggtgggtattccccagtactttggcaatttccgcgatctcaacgagagtttgtttatcaaacattgacatttggcttccaatattattacattcaataaattcattgaatgcaataatatcaaagttttttgggcgcggcgagtgtcagataagtgattcaactgcgatgaatggtcaaattaggaggatggcaacaaatgaatgaagggctggagttgattgttcgttctgtattgatcggggctggtgcaacggttgtgatggatctttgggcggttttcataaaacgcagctttggagtgccatcactgaattattccatggttggtcgctggattgggcatattccaaaagggatatttgtccataaaagcattgtacaggctgaacccgtgaaaggtgaaacggggattggctggttcgcccattacctgattgggattattttcgcgggacttttattattgatttgggggctggattgggcgaaaaatcccactttgatccctgcattgattgttggtatcgttactgtcgtcgcgccttattttattatgcagcccggtataggaatgggaattgcagcatccaaaacccccacgcctaatatcgccagattaaaaagcttgatggcgcatacgtcttatggtgttggtctttatttagctgcactcctcctgacattattttcttaatgtcaatcttaatgaccgtcgataaataactttatgtttatcgacggtatatattaatcactactctttatcacctatttatctatcccattaatgtattattaatgattatttcatcatgtctttttttattgttaaaatactcaaaataattacatcaacatataaaatggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcgtaaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccattttatcgagttataatagcctttttgtgtggttcggattaattgtctggggaatgtcttttggtggtgcgccgacattattgcaaacagcacttgctgacgtggcggaagaaaatgcagatgtcgcccaatctatgctggttactatttttaatctagcagtcgcagggggaggtattatcgggggaggtttactcaataattatggtatgacttcttttccgattaccatgattgctctttcattatttgcattaagtttagtctggcgagccaagaaaaatggtttcagacccggccaaagaagatagaaatctgttatatcagaaattannnnnnnnnnnnnnnnnnnnnnnnnnnnnnnnnnnnnnctaaaacatagatggctgagaaacagaaacttgactaacctgagatttgcttaagaagggaactaaagtgcctgaggcacgatcaaagtttttgctaaagaaaataaaattgtggagatcctcaggcatggttaatttagaagaattttactgctgcgtcgacagggcaaacgggtctaaatgatactgacgtaaaccccaccgttaggactttcagctctgtcgcattaaaaaccgatatcgggtaacctacgtacttttatcgagtcagttgcccatgtctttaattcgaaagccttcaaacggctacactatcctgtcgatattatcgctcaatgtgtcagttggtacctggcctatgccctgagcctgcgtaatttagaggagatgatggccgagcgtggcattgaggttgaccactcgacacggcaccgctgggtaactcgtttggtgccgttattggataaagcctttcgccggtacaagcggcctgtcggacgtcgatggcgaatggatgagacgtatatcaaagtgaaaggccagtggaaatatctgtatcgagccgtcgatacgaccggacagactatcgatgttctactgacggcaaaacgggatgcgcctgcatcattgcgcttctttcacaaagcgatacgccaccacggtgagcctgaggtggtgaccattgataaaagcggtgccaacaccgcggcgctagacaagctcaacgccgataagccggaagaagaaatgataaccatcagacaaaacaaatacctgaacaaccttgttgaacaagaccaccgcaatatcaaacgtcggacaggctctatgctcggatttaactcgtttcgtcgagcccaaaccctgttagcggggatcgaagtcgtttcgatgttgcgtaaaggtcaatatatacaacccaaagataatacattatctcccacagagatgttttaccgtttgattgcctaaataataaccaatcccactttcattcaaactttcgctgttaattcgacagaaccttccagtgtgctatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatacaatacaggttgaatatattaataattaactgatattaataggataagtgcctattattcgttaatcatataataattatggagagggtgattgctaaagtcgtgggatgatgggaattgggaaaaaatgagaaaaaggtattgatagatttgttgaatatttgaaatcgggatgtcagtacatcccgattcattattgagaaatcacctgtttaaattaaataacgccatttgatagtgttattttggcgattcttcagtctccggtaatgttacattaagttccagtacggatatgtcatcatctttttgctcaaactgcacagagagcatttctgggtcgatttgtacatatttacatataacggccagaatatcccgtttcatttcgggcaaataagcaggctcggaatcaccgcgccgacgttctgccacgatgatttgcagccgctccttggcaatattggctgtcggtttttttctcgacaggaagaaatctagcaaagccatgcgttatcccccaaacaagcgttttaaaaagccctttttttcttcttcgataaaacggaaaggccgttcttcaccgagtagacgtaaaacggtatcttcgtatgccttacccgcatcagattctttatccagaatgaccggttccccttggttcgatgaacgcagaacagattgatcttccgggataacaccaagcaaagggatacacagaatttccagcacgtcttccatactgagcatatcgccccggttcacacgccccggattataacgagtcagtaggagatgctctttaatcggttcattagatttttctgcgcggcgtgatttggaggccagaatacctaagatacgatcagaatcacgaacagatgaaacttccgggtttgtcgtgataattgcttcatcggcaaaatagagcgccattaatgctccgctttcaatacctgctggtgaatcacagataataaactcgaacccttgttgatccaattcattcagaattttttcgacgccttcacgggtgagggcttctttgtcacgggtttgagacgcgggcagaatatacagattctcggtacgtttatctttaataagcgcttgatttaatgcggcatcaccttgaataacattcacgaagtcaaaaaccacgcggcgttcacagcccatgatcagatcgagatttcgtagaccgatatcaaaatcgataactacggtttttttcccactttgggcgagaccggtagcaatggccgcgcttgaagtggttttgccaacgccacctttaccagatgtaacaacaataatgcgtgccatgaagcgattccttgttataagggctagactaaggtttcaatagttaattcattaattaccaaacgtaattttgcagccttgccaacaaaattttctggaatattttcgctgagccaatattgacctgcaatagagcagagttcagcgtttaaatgggtgcagaaaatctggctttctttatcaccagatgcgcctgccaatactcgtccacgtagcacaccatatataagaatatttccatcagcgattaattctgcgccagcgctgacattactggtgacaataagatcgctatttggcgcataaattctttgtcctgatcgaaccggcgtattaattatacgagtttttttgaaaataggttcagtcggtttattttcttgagtaggaattttctgacttttaccttctttcagtaaaggtagcccagattttagaacaatttttcgttgatcttcatcctgacagccgctgatgccaacaatgcgcaacccgacagattcaacagcacgatagagtgcgaggagatcggcaccggctggaagatcagatatattgattacgaccggggcatttttgaggaattctggtgcttgctccattttttcctgcattgccctttgaatgacttccggctggtcatcatgcaaatgaacgaccgaaagcgtaaaattactgccttttagctcaattggcgactgtgacatcgatattttgactcagcaaggttaagttccccagaatctgggatgcgttattcttaaatataataagcatgttatagttactgaattattcaagcaagtcgcagtgttaatttaaaagagtttatgacaatgatttgtgtaatctacagaagcccaaaacgtgaccagacatttctctatgtcgaaaaaaaaggtgatttttcacgcgttcctgaagcgttgctgaaaacattcggtgaacctcaatactccatgatgatttcgttatcaggaagaaaaaaactcgctaatgcagatattgaaaaagtaaaaattatgctgagcgagcagggtttttacctgcaagtccccccaccagtagaaagtttgatgagtgaacatctggctgtaaataagtgatggcaaaaatagccggtaaatatttgatcctgaaggtgaggaattgattcatgaaattaatatctggtgtggccttaatgacagtaacactgttggtagggtgtacttcatcgaatggaaaagtgttgcaggatcaatccagacaggcggttgtgatacagaaagaaatcagggtattggatggacaatttcccattgcttctcgtgaaccatcacaatttcctacctatgtggctttactgaaacaacaagctaaagagcagggtttcagtgaaaaaacattggatcgtgcatttgctgatattcattttatctcgcgggttattcaatctgatcgtaatcagccggaaaaaaaaattacgttggctgattaccttaaccgcgtcttgtcagcccggaagattgaacagggcgtcatccagtatcagaataacctgccccagttagagataatcagccgcaaatacggtgtaccgaaagactatattgttgctttatgggggttggaaagtggttttggcaaaattcagggaaaggaagatgtcatatcggcattatctacgcttgcctttgaaggtcgtcgggaagatctttttataaaacaattaatggcagcacttgaaatcatagaaaagaaatatattgatgaacatcaaactttgaaagggtcttgggcgggagcgatggggcaaagccagtttatgccgacctcgtacttgaattatgctgctgacggtaatggcgatggcaaaatcgatatctggaacagtaaggaagatgtatttgcctcaattgccaattatctggcgaaggaaggttggcaacaaggattaccgtggggttatggggtttcactgcctgctggtttcgatcaaaacttggaaggcgttaagttagagcagggaaaaacgattatccaatggcagacattgggtgtttcatcccccaattttgccagtctgccggtaaataccaagggttggattgtgataccaaatgatactgaacagcgggcattctgggtaacgcagaatttccgtaccatcatgcactggaaccgttcttacaattttgcccttagtgttggtatgatggcagatcatattggccagaaaacccattttctcactcactgagaatctgctgttgaagacagataaggaagaatgctatgtaccagcatcgagactggcagggtgtactgctggattttcctgccaataaagtggtttgtgtcggcagtaattacgagaggcatatgaaagagatgggctctaaagtgaccgaagagccggttttatttctcaagcctgaaacggctctttgtgatctctgtcagccggtttccatcccgcagggattgggagctgtgcaccatgaaattgaattagcagtcttgattggtacgacactcaagaatgccaatgaggaacgggtcggcaaggcgattgcaggttttgcggtagcactggatctgacattgcgtgatttgcagcataaattcaaacaatctgggcaaccgtgggaaaagagtaaggcgtttgacggttcatgccccatatcggggtttattcctgtcaaagtctttagtgaaccacaaaatgcccagctttccctgacagtgaatggcgaatcacgccaaaacggtaatacgagtgacatgcgaatgcccatcatcccattgatcagctatatgtcgcgtttttttaccctgcgccccggcgatattatcttaacgggaacgcctgaaggtgtagggccactacaatctggtgatgtactggacgtctctcttaatgagcacgttttaacaaccagagtgatttaacaatgaggaatgactgaacttatgtctcaacctttctggcaggcgaaaactctggaacagatgacagaccgagagtgggaagcattatgtgatggctgtggtcagtgctgtctgcataagctaatggatgaagatactgatgcaatctatttcactaatgttgcctgtaatcaattgaatatcaaaacctgccagtgcaagaattatgcagatcgttttagatatgagcctgattgcatcaaattgacgcgtgagaatatggtcacgtttgaatggctaccgatgacttgtgcttatcgtttgattggtgaaggaaaaaaactccttccttggcacccattagtcagtggttcaaaatcagccatgcatgcagagcgtatttctgtcagacacattgctgtgcgtgaggctgatgtggtggactgggaagatcatattatgaacaaaccagagtagttatattacttattgatataaaagggactttatatcatatggctgtattttgggtatcggtggggcatgagaaataaatccttatactcccggggttcgttttcttgccgtcgtactgcaaatcgaaattcattggtatagttaacaaattaagataatgattataagatatatatttcataaagattaataacacattaaataaacctcgtaaaatatattatatatacccaattattttaattattttaattattttaattattttaattattttaattatttacaatatttaatttttatataatattataggtaaatatatttcattttttattgtgaatttcggtattaattaatgatatttaatgtcagtctattttaatattttattgacgttgtaataaaaagtaattacttaacttataaattaaggggtataatatgtctattgaaaatataaatatcaatgagcaaaaaattggtaaagattcagttgtacttgggcatgcggaagcattggcaatacatgctgtcgccattggtgcttcaccacgaaattctaaagccatcagtgaagcggctattgctattgggcaaaatcaacttgccggtaaacagggagatgcgaccgttgtttggccaattgcaattggtgctgattctgtatccagtggcctggcttccatcgctttggggcaaaaggtaactgccagtgcatctcaggccgtagcgattggccaacattcctctgcaacagaaaaaggaagcgttgcattgggggcagattctattgcgaacaaaccgaatgttgtttctgtaggaaaatctggtcatgaacgtaaaatcgtgcatgttgccgtcggtgatatttcaaatcatagtactgatgcggttaatggtcagcaattatattctgaaaccgcgaaaattaatgtattactggatgaaaaaaataagcaattggaaaatagaatcgaaactcttgagagtaatatagccaatctcactctattaaataagaataatgcagatgatattgaattattgaagcaacggctctttgatgcattaaattattaatataaaatgatttttattttatattttttggtcattggtactatatccgtaataaacattgcgtgatgataattcgctattttttcaaaatggttatccattcgatagggatatttttacgaaaggtatctatggattcagggtggttaaactttgtaatgatttgtaatttacgaggtaggtcagacataaaaatttggtctcaaattattgtttgggaccaattatgtgtgcgcataccggacatcaccacacatcggattgccatgaataccggattttcctctcatatttcttgcttttatcagccaagaaaaactgataacttgtctgctccacagtcaatacaaggaatgataaatggcaagttatttggttcgtgtagaactttatggcacgggttctgatggctatgagaagttgcataacagaatgacagcaaataagttcaataaatcgatacaatttcctaatggaaaatggcatcgtcttcccagtggaacttatattggtaactcatcgctggaatcccttcaattagcggaaaaaatcaaatcaatcgcgacccctttctcaagcaaagaaccgtcgatatttgtctgtatttacagcaattggagtgcagcattgtatcccgataaaggaaccggctgaatcaaattaagtgttttactgtttaataattaaccccagatgttcaaatgaatattgttctatttctgccacaatccagccaagatcgtatcaattgtaataaataatagaatggcattcatatgacttaccaaatatatatggagtactgttggtgaggatttgaagtcagaccatcagagattatctcatgcagctatgcaagtctgtttgataatgagaggtgaaaaaatgaacagtgaatggctggtttatataaaatttgtaggattatggattgctttaatgctgatgattggtgtgatgttgtcataaaagataaaaataacatgaatgtgtgacctcgtttctatttcaggagattgatttgaggaaaatggctatcaaatggataaccagctgaaaatgcgggttgagctgattacccagtatgatactgggtaatcaaaaatcgttttggtgaaagtatgctcagaatgagaaaaaataacgttatgtgattaaattattgggtaatatccctcaaaacataaaccagcgtgtttttgtcattagttaatgtaagctgttttctctttaatctgaccgtagctccctcagtcagtacatcataaatcacttgatcccattgatgaagctgttcattgacacaaaacatctgggatttttctaaaatactgacagtcagaacacgcttctttaatttacctattcccataaaatgattgcacatagttgctgaaacaaacattttttcactaaatgcaatagaaagtttactgtcttctttattcgaaacagttgcaccattgacactgattaaagcaaaattacgatgttgtagatccctgaccgtaacattccccgtggcgctaacccccgaagactgacatgctgtgagtagcagggtcgcgatcgcaaacgaaatcgctttcttcattttatctcctgatgtgcgtaaaaattacccaacaagattcgggcaagacttgccggaggttaattgctggatattttgtaaagtcgtttcactgatactggttaatgcttcttctgtcaaaaatgcctgatggcctgtgaataacacattatggcaggaagacaagcggcgaaaaatatcatcttggatgacatcattcgatttatcttcaaaaaacaagtcacgctcgttttcatatacatccatacccaatgcaccaattttctgctgtttcaacgcgttaatagcagcaattgaatcgattagtgcccctcggctggtattgatgatcatcacgccatctttcatcttattaaatgctgtttcatccagtaagtgatggttttctggcgtcataggacagtgaagagaaatcacgtcagattcggcgtacaaggtatctaaatctacatatttcacgccaagttctaacacttccttatttgggtagggatcatgtgccagcaaacgcataccaaaacctttcaaaattcgcagtgtagccaggccgattttccccgtaccgataataccggctgtgcgtttatacatgttgaagccagtcagtccttccagagagaaattggcatcgcgggtacgctggtaggctcggtgaatacgccgattcaaacacagcattaatccaaccgcgtgttcagcaacagactcaggtgaataagccgggacgcggacgacttgaatgcctagctctttggccgcatccagatcgacattattgaatcccgcacaacgtaacgccaaaattttgatattcattgctgccaattcttccagcacttcacgcccagcgtcatcattgacgaaaatacagatagcatctgcaccaatggcatttttggccgtttgtgggcttaaggaaaaatcaaagaattcgatatggtaatcaagcccaagtctttggttgagcatttcgaaatgtttacggtcatattgttttttactataaacaaccaatttcatcgtctcgtctccgttatatattgactgtggaatttttaatttcatcgttcattcgaaccatttgttgcattcactactcgaacaaaccgactaataagctattcatgataatagcccgtataataaaccagcttagagcctgatatgaaactatcataacaggatgttgtgcatagattgaaaataagagataaggatgtaatgaccaagatattcaaagtgtttgcggtgatgataacactgctggtgttattggtgttggctggttggtacacacttccgcattggctgccattgattgccagtcattggttgccacagggcgttactctttctctcagtcaaccaaaatgggaaaagaatacattacggctggatgatttggcattgaaagcaaaaggctgtgaatgggtcaatgtgtccgggctgtctgtgggatacccacgcaaagaacaaaccaaagagcactactggaatattcatgcttttagtgttcacagcaatagcccgtgtctggtgcagttgccagcgacagaaaacccgtcagcaccattatcgattgaggatatattatcctccattcctgcggttaaacttgtcgttgatcactttgaacttacgccgtggcaggagtttgccggcaaactccaatttgattcatcacgtcaagggcagacattttcctatcaaggcaagcaattaaagctgaatgttcatacggcagataaaaagacattagttattcaccaattccttgtgaaattacctgaacaggaaatcagcctgaatggggatatctcgttgccattggatatagacgcactacccgcacaaggtcagataacagggaggctatccatcagtcaatatcctgatcctttgcagataatattaaaatggcaggggcagggaggaatgctcactattagggaagagaggcaacaacggatattggcagagttgccatggtcattcaatcaatctcaatttttgataactgatggtaaatggcattggatggatatggggcagccactgtcaggaggtgtgaatctgacctttgatcactggaaagaaggtatgggtggcatgttagtcagtgggcgagtgaatttgatcacccaaaatgaactaggtaagggcaatatcgttctttctataaaaccggcacttatcaatatggcgaatgctcatatcccgtttcagttaaccggacaaatgaaccatgggcagatggtcataacgatgtcattgcccgctattgtgacgggcccgctggtggcacctaaaatcacatttcagccgggtgcgctgtttcgtgcgtggggaaaagtaagcgaaacctttacggttaaggaagcgcgtttaccattggcggggacttatctgacccgtgatggtcttacgggtcgtctgcaagctatcgtgactgcacaggatagctattggggaaaattcaaactgcatctcgatgggaatgccgaggattttatccctgataagggaaattggcattggcgttattggggcaatggacacttacccccgctgcaagccaaatgggatattgcaggcacaggaagctggaatcgttcacaggtaacggtgaatgcgttaaacacgggttttgatgttatccaatacggccttgtgcaggtggaggcaccgcgtttgcaacttatcaagccgctggtgtgggaacgttccgcaactcaaccgacattcatgggggacttgcagttatccaccttaagaacagattttcgttctggcggttttttgcctcctttcgattttaaggcgaccgtgacaggtcagtcgccggataattttattctgaatgggaaattatcccccaaaggtattgagccaatcccattttatggtcgctgggacggtacgcgattgcggggagaggctcgttggccgagtcaatctctattagcacttcagtccttgatccccgcagatttggggatgatggtgcgtggtggaaacctctatgctcaagcggcattttcggctgcgaaggggcagggattacgtgctggtggtcattgggtagtgaaaaatgcgagtgtttggctaaaggatggcgaaattgacggcttgaattttgttttgccgtggcgtttgcaggaacatacttggcaattgggggtcacatcacctgtccaactcagggtcaatgaaattaagggcttgtttggtatgcagaatgtgacagccgatttgctgggtttctacccacccactgaaacccagccgttgacgttattcaatgtgaatgtggacatgctggatggtaaacttgggctggataaacttcaattaccccaaaaacaggctgcggtactacgatttgataaattaaatctgagcaaattgttcggtgttctgaaagttaagcaaatagctatgtcgggcagaatcagcggggaattgccactattattgaatgataaaaattggattattcagcagggctgggtatccaatgatggatctctgacattgaggttagataaagatacggttgactcgatagggaaaaatgacctgacggcaggtatgacaatggattggctgagttatttggaaatcagccattcaaaggcacatgtgacactggataatttgggcactttgatactgaattcagaggtcatcggcgttaatcccagagtggataaaaaacgagaagtcagacttaattatcgccatgaagagaacacttttcagttatggcatagtctgcgctttggcagtaatctggaagagtggttacagaaaaatatatctgtaaggagtgacaaatgataacaaaaactgggctcaggttgtcggtgggcatagcgagtctgatgttggccagcataattttgacgggatgcatcaggctggaggtagcgacaccggataaaccgatcaagatcgagatgaatgtgaagattgagcatgaaattcatattaaagtcgatagacaaattgaagatatgctcaaaaataactccaacttattttaagggccagaatatgaaaaaagcaggagtaatatttctggcgagtctgctattcagttcttttgctgtaggcatgacattgagtgaagcaaaacagcaagggctggtaggagaaacgttcagtggctatttggcacctgtgaagaagaccagggatactcagtccgtgatccaaaaagtcaacgaggagcgggaaaagaaatatgctgaaattgccgcgcaaaataatatgacaacgaatcaggttgctaaaatggcgggtgaaaagttggtgaaccgtgctggggcaggtgaatatgtgcttggtattaatggtaactgggtgaagaagtaaaatgaaaaagcgcgccatctggcgcgcaaagaaaatgcaataaacactcggtctaattttgcagtaataattctgagctattcattaagctgaaatttttgccatcatatcatttatggtattctgggcagattggtgagccagttctgccgattccgcacccaatccgaaaccctctgcaaagacgaattcaacatcgttaataccgatgaatcccaaaaaagtacgcaggtacggtgttatcaaatccgttgggttatctttatgaatgccgccgcgactggtcagcacaatggcacgtttgtttttcagcaaaccttctggcccggtttctgtatagcggaaggtcgaaccggcacgggcaatcaggtcaaaataggctttcaattgggttggaatagtgaaattatacattggggcagtaagcacgatcacatcgtgaactttcaactccgcaatcaattcatccgataaggctaatgtagctttctggcgtgctgtcatctcgacatcacttggacgcaaagctcccaccaattcgctatcaagcactggtactgggttttcagctaaatcgcgcacagtaacgttatcatctatgtggttggcctgccatttttcgataaagtaatcagccattttgttgctttgggaatgctgcgccagaatgctcgatttcagaacaagtactttattcatatttcaattccttgattaacacagggtaactgatgtgttgctaattgtgtcgatgtgtcagctattttatgtcgtatatcgttcaggcaatagctcaatatttcgagattggcattcaaatttattgaataacggatttgcggttcagatggatttcatcggggtgatcaagatatgttacacttctaatatttcaatcaataagaacctatcctattaatctaccgaaataggttttcagactcagtgttttaataagaagatattgtgttgacaataaaagcggtgttgagaataaagacagcgctactcaattaagaacatcacaaggatttatcacagtggaatcacctttgacagcatcgtttgctgaattattcgctgaacttgagcacacgccactgcgcgatcagttccggttgaaaaaacgtctgcatggggcagcaaaaatcaaaaatcaggcctccttacaggccgtggcacaatccatttctggagatatcgccactgcaaaacagaaagttatcaatcgtcaagcctcatgtcccccgattaaataccctgaaaacctgccggttagccagaaaaaagacgatatctacaaagcaattcgggataatcaagtggttattatcgcgggagaaacgggttcaggtaaaacaacccagatccccaaaatctgccttgagttgggaagaggggttaaagggttaattggtcatacgcagcctcgtcgcctggcagcacgctcggttgccagccgtattgcggatgaactggaaactccgcttggctcaaccgttggttataaagtacgttttaatgatcatgtcagcgagaatacgctggtcaagttaatgacggacggtattctgctggcagaattgcagcaagatcgcctgctgctgcaatatgacacgctgattattgatgaagcgcatgaacgcagcctgaacattgattttatccttggctacttgcgccagttgctgcttaaacgtcctgatctaaaaattatcattacctccgcgacgattgatcctgagcgtttttcccgccatttcaacaatgcaccaattattgaagtctctggccgtacttatccagtggaaattcggtatcgtccggtggcaggcgatgataatgacagcgatcgggatcaactcgaagctattattggtgctgtagatgaattggggcatgaaagttcaggcgacattctggtgtttatgagcggggagcgggaaatccgtgatacggcggatgcactagataaacagaactttccgcatactgaaatcctgcccctgtttgcccgtttatctaacagcgaccagaaccggatatttcagccgcatgtcgggcgcagaattatattggccactaacgttgcagaaacatcgctgaccgtgcctggtatcaaatatgtcattgataccggttttgcacgtatcagccgatacagttatcgaaccaaagtccagcgtctgccgatagagccgatttcacaggcatctgctaatcagcgcaaaggccgctgtggtcgtgtttcagatgggatctgtatccggctctactcggaagacgattatttatctcgtccggaatttaccgatcctgagattctgcgtactaatttagcttctgtcattttgcagatgacctccattggtttgggcgatgtgagcgcattcccgtttgttgaagcgccggataaacgtaatgttcaagatggtgtccgtttgctggaagaactgggagccattgatccggaatccctgtcaggcggaacttaccggctgacacaaatggggcagcaacttgcacaactgcctatcgacccaagattggcgcgtatggtgttggaagcaagagcgcatggttgtgtccgtgaagtcatggttattacctctgcgttatctattcaagatccacgggaaaggccgctggaaaaacagcaggcttctgatgaaaaacaccgtcgtttcgcagataaagattctgatttcatcacattcctgaaattgtgggattttctggttgagcagcagaaagcgctttccagctcacaattccgcaaactgtgccgccaggactatctgaattacctcagagtgagggagtggcaggatgtctatactcagcttcggcaggttgttaaagaaattggcctgccgataaacagtcaagaagcggattaccgcagtatccatattgcgttgttgacgggtctgttatctcatgtcggtcagaaggataccgataaacaggaatatactggtgcacgtaatgctcgtttttctgtatttccgggctcaggattattcaaaaaaccacctaaatggggaatggtggctgaattggtggaaaccagccgattatgggggcgtattgctgcacgtattgaacctgaatggatcgagccattggcagcacatttaatcaaacaccattacagcgaaccgcattggcagaaatctcaaggtgcggtgatggcaacggaaaaagtgacgttgtatggtttgccgattgtggcgggacgtttagtgaattatagccagattgatccaatgttatgtcgggagttgttcatccgccatgcattggtggaaggagactggcagacccgccactcatttttccgtgccaatctcaagttacgcgaagaagtcgaagaactggagcataaatcccgccgtcgggatattctggtggatgatgaaaccttgttcagtttctacgatcagcgaatcggtaaagaagtcatgtcttcccgacattttgatcgctggtggcaagtcgccagtaaagatcaacctgaactgctcaactttgaaaagagcatgttaatcaaaggggatgcagataaaattagtgcttcggattatcccaactattggtatcaagacaatttgaaattccgtttgagttaccagtttgagccaggaacggatgcggatggtgtcaccgtgcatattccgttgccgatcttgaatcaagttaaggatgaaggctttgactggcaaattccgggaattcgtcatgacctggtcgttgcattgattaaatccctgccaaaacccgtacgtcggaattttgtgcctgcacctaactatgcacaggcatttttggagcggataacacagccgcaggctaccttactggatagttttgagaaagaactccgtcgtatgacgggggtgacagtgtcacgtgatgattggcagtgggatcagattcctgatcatctgaaaatcacattccgtatcattggtgagaaaaacaaaccgctggcggaaggtaaggttctgtctgcactgaagctgcaattgaaagggaaagtacaggaaacactctcggcggtagcggatgatggcattgaacaaagcggactgcatatctggagctttggcgaattgcctgaacgttacgagcagaaacgcggaggttattctgttaaggcatttccggccttggtggatgaaaaagacagcatcggtattaaacttttcgagactgaatctgaacagcaaaacgcaatgtgggaaggaacccgtcgattgctgctaatgaatattccgtcaccgattaagtacctgcatgagaaattacctaacaaatctaaactggggctgtactttaatccctatggaaaagtgctggatctgattgatgactgcatttcctgcggtgtagatagattaatcgcagaaaatggtgggccggcatggaatgaagaagcatttgcaagtttacagaataaagttcgggctgacttaaatgatgcagtggtcgatatagccagacaggtcgagcagatcttgacgactgttttttctattaataaacgtttgaaaggaagggtggatatcgcactcgcgcttgccttgtcggatattaaagaacaaatttccggtttagtttttaatggttttgttaccgctcacggctggaaacgtcttgcggatgttttgcgttacttgaatggcattgaacgtcggctggaaaaattggcgattgatccaaacagggacagggtgcacatgagccggattgaaaatatccaacggcaatggcagcagtggctggcgaaactgtctattcagcagaaacaattacctgaagtgaaagaggttcgctggatgatagaagaactgcggattagcctgtttgcccaacaattgggaacagcatacccaatttcggataaacgtattttgcaggtaatggaaaatatcgctatgtagtctttaggggctgtaggtaactcaacagccccgtatttacattggccgataaaagataacgatgactacaccgttatttagaataaaaattctttgctaattttgtccatagctcagcgacaagtggggaagtcggcttacccacagttgaggccagctcacacagagtggggtgagtgaacactgccgctaacggaatctccatattttgctcatacatacgagccagcaattgtatcgctgtcagcgaatggccgcccaactcaaagaaattgtcatgccggccgactttttcccgtttcagcagcttctgccagatttgtgccagtgccgtttccatgtcaccgatgggggcttcatagccgcgagccacggcagtttcttcacgcactccgtgggattgggtgaagtgctgagtcaaggtatcttgcaactgccgatgttcggaggcagtcagaatggagaggctcaggatcggccgttgaggttcggtttccaacgcctcaaccagacccgccaaggcggtagtcatataggcgatcagacccgccggatcgatacccggtacggtctgagccgccaacagaaagcctttacccaaatcatccacagtcaagtagaggggatagttagtcctctcctgtgcagtcgtcagatgtatgccctcccatagagtgcgggttatatccgattggctatggcgatagttaaggagtgaactgaaaagtggcaggggtggcgttacaccgctacagcgctgagccagcgccaatggtgcctgctcgtgttccagcaaccgtgtcaaactacgataagccgctttcaccgtctcctgtacactgttccctgcaagttggatccgcacgggcagcgtattgataaacagacctagagtccgctcaatgtcggcgcttccctgcatgcgccccagcaagactgtcccgaagaccacatcatcccgcccgcttatttttgccagcacctgcgcccacgcgacatggaacagcacaccgggactgactccctgacggcgcgcttgcgtgcggatagctctggccagtgctgcacgaagtggttttatgacctcagttaccggtcgattcccactgtagacatccagtattccgaaaggcgcagtcggtgtatccacgtcggcgagcatctcacggaaataggcttcgtgatctgacatcggtacacgcagggactgggcgataaagtgacggtaaggtagtgcaggaggtaagtcccctgtacgatggtacagcagttcgttaatttcattgatgatgagatctaatgacatatggtcgttgagtatatggtggcagcatagagccagtaaccacttatcttgatgcggatcatgggcgatatcggtggataagagtggagcctgactgatatcaaggcggtgtcggtacgggtcagtgtgtgccagtaactgagcgggaatgtccttgtcgctgtccggcacaaaggtgtcgatgcgcaggggcgcctgacgccagacaatttgcactggctggggtaatttctgccagcagaaggcggtgcgtagaatatcgtggcggtcaatgacttgttgaaaggccgtcagaaaggcatcaagacgttcgcgggtgtcgaaagtaagcaagatatgtaacagataattatccccttgtgtttgcagcaggtggtggaacagcataccttcctgtaacggggcgagtgggtagatatcctggatattagcagcaccagcgggaagggtagcagcaatggcatcaatctcgcattgcgtcagggagatcaggggcaacatgtctggggtgatggcggtacagccatcaggaatgagattggacggtgcggtaaatgtagccgcgttatccccggctatcagcatcactttcgccatttcggtaagcacgggtgtggcgaacacggtgcggatgtcaaggctccaaccttgcccacgcagccgttcgatcaggctcaccaccatcagcgagtggccaccgagttcaaagaagtgatcataacgacccaccttttccagacctaataacgcttgccagatctcggccagtgccatttctatgtcgccgactggcgcttcataaacacgggttacgatcgctgcctgatccggcgtcggcagtgcttgacgatcgagcttgccattgggtgccagcgggaaggcgtcgagtgttacaaaggcgctgggtagcatatattcggcaaggtgctgcgcgagctgctggcgcaattccgctggcaccagttccgcattcggttcggcgagcagataagcaaccaagcgcttgtcgcccggcataccttcacaggtaaggacttctcgatgaagcacaatagcctcacgcacgccgtggcattgtagcaatctggtttcgatttcccccagttcgatacggaaaccgcgtattttaacctgaaaatcattgcgaccgaggtattcgatattgccgtcagtccgccagcgacccaagtcgccggttttatacatacgggcgttggggtggttgctgaatgggtcgacaacaaatttctctgcggttagttccggttggttcgaataaccacgggcgacgcccataccaccgatatgaatttcgccgctcacgccgacaggaaccggctgaccgagcgcatccaaaatatagatgcgggtattggacagcgggcgaccaatcggaacgttgtcggtcatagatggagtctgtttgtcatctatcatcagtgccgtggcagtgatggttatctctgtggggccataggcgttgaaccaacggcaggattgcgtttctgggcacgacaaccagtccattaaataacggtgttctactttatcaccgccaacaatcacggtgtgcagataggggctgaaaccaccgcgtcctgccatgatctcttgtacccaatggtgccagaaggcggtcgggatattgatgatagtcattttctgttcgcgtaagaaatcgacaaaagtgacatttggtattttgatatggggtggacgcagaaccagtgtggcgcctgatgcaagggtggggaaaatatctgacaccgaaatatcaaatgatacggttacaaattgcagaatacggtcgcccaagctgggcttactgatctggcattgagcatggataaggctcacgacattgtgatgttccagcatgacgccttttgggtgtccggttgagccgagtggatattaggcaatgggcggtgagcccatttgtcctgtcagggttatgtgcaggttgtttcgctacgctattttgatgaattttatcatccagcagccagatggacaggtcttgtattgagaagcgtgtttgtaaatgcttctgagtcagcaatatgacaggtttgctgtctgacaactgataaaccagccgttcagtgggatattctggatcgagtgggatataaccggcaccggcttttaagatcccgaacagaccgatgatcatatccaaaccccgttcaacacaaatcgccacacgatcatcagggcacacgccaaaggctatcaggctgtgtgccaattgattggcgcggcggttgagttcactataactcagtgagtgtttctcaaagattacggcagcggcgtccggtgtgcgttgcacctgagcttcgaacagttgatgaatcagcccatgttgcgggaagtcaacttgagtggcgttgaaatcaaccaacaactgctgacgttcggcaacagacaacatcggcagacgggcaatggcttgcgtttcatcggccgccatggcggtcagtacttgagtgatataacccaccatgcgctcaaccgtcgcacggtcgaacagatccgaggcatattccagataaccattgagatcatccacggtttcaatgagtgacaatgtcaggtcaaagtgcgcgctgtgatgtgtttgttcaaccaacgaaacggataaaccgggtaattcaaagggttgggtgggggtattgttcagcgccagcatgacctgaaagatcgggctgtagctcatactacgctcaggttgcaggatttccactatttgttcaaaaggcaggtcttgatgagcataggctgccagcgctcgctcacggacgtgggcgagcagttctgccacgctaagttccgccactgtgttgcactgccccaattcgatacgcaaaggtagggtattgacgaaaaagccgatcaacccttcaagttcactccgtggtcgattggcgacgggggtgccgatgacgatatcgtcctgaccactcagacggctaagcactatcccccaagccgtaagcagagtcataaataacgttgtgccctgacgctgcccgagcgctttgagggcagtcaataagtcagcatccagatggataggcacatgactgccgacgtaacgctgctctggtgggcgtggtcggtcggtgggcagtgccagcaacgtcggtgcgccctgaagtcgctctcgccagaaatcccgttgtgcagtgagaatatcaccctgcaaccattcgcgttgccagacggcatagtcggcatattgaatagacaggggcggtaaaggatcaccatgcccctcaagagcagcacagtagagtgctctcagttcgtggatcaatacccccactgaccaaccgtcagtgatgagatggtgctgggtgaggatcaacacatgctcttcgtccgccaattgcagcaattgaccccgaaccagcggttcgctggcaaaattaaacagggtttgtgtttcgagttccatcaattcgtcaatacgggttaggcgggaagcctcgtctaatccgcgcagatcctgacagatcagggtaaaaccgatatctgcgtcgtcgatttgttggtaaggctgttcgccaatcaggacaaagcgtgtacgcaggctttcttgtcgggcaacaaggttatcgagtgtggctgtaaatgcggtgtggtctaactgtccgtgcaggcgaagaaccgtaggaatatggtaggccagactggccttaggattgagttgggcgatgaaccacaggcgttgctgggcgaaagagagcggtagtgactgacggcggtcggcggtcagaatgacggtttgcgtggtcactgatgcgctgatgagtacggcagccaaatcagtgaggacagggtaggcaaagagttgggataaggacagttccaaccccagcgtctggcgtactcgtgaagtaagctgggttgcgagcagggaatgaccaccgagctcaaagaaatggtcgtaacggctcactctttccagccctaataacgcttgccagatctgagccagtgcgatttctatttcaccaatcggggcttcatagccgcgtgtcactatagcggacaggtcgggggcaggaagcgcttgtcggtcgagtttgccgttgggggtcagcgggaaggcgtcgagcgtcataaaggcgctgggctgcatgtactcggcaaggtgttgggcaagttgttggcgcagttcggccggcaccagttcaacgccggcctgaggcagcagataggcaaccagacgcttctgacctgtactattctcatcagaaatatcttctcgggcaatcacaaccgcctcgctcacaccgtggcattgcaccaatctggcttcgatttctccgagttcaatccggaagccgcgcagcttaacctgaaaatcgttgcggccgaggtattcaatattgccgtcgggcagccagcgacccagatcgccggtcttgtacatacgcgctccggctattgttgtgaagggattgggcaggaaacgttccgccgtcagttcggggcggttcagatagccacgggcaacaccggcaccagcgatatagatctcccctgtaacaccgagcgggacaggttgactgtcggtgtcgaggatataaatttgggtattggcgattgggcgaccaatatgagcgacaaagccagtcatccggttcatgcgtatccaggttgaataggttgtcgtctccgaagggccgtataaattgcacacctcctgtacagaagaacaagcaaacaattgttcgacaacgtgaggtttcagtgcttcaccagccaaattgactgttcgggtagccgcagggatcgcgttagtgtcgatcaaattcgtgatagccgatggcaccgtattgattaggctgaccgatggttttttggtaaccagcgaaagtgcatcagaaacaagatgaactgtgccaccggagattaaaggtgcaaaacattcgtacacggctaagtcaaaattgagcgaggtagcgaaaagagtgtgggctagctcttcagggcggaaagcttgttgtacccaggtgaggaaattcaccgtattgcggtgttcgatcgccactcccttgggcagaccggtagagcctgaggtgtagatcacgtatgctagatggcgtgacgtcagacccagtgaccgcacatctggattatcggttggcatagcctcaatcaatggttctgggttgtcgagtattattatgggcataaccgtaggcaccgtgctggccagacgatcggcgagcatcttctgggttagcatcacctttggtgtcgcgtcttcaagcatatacgccagccgctcatcgggataagccgggtcgagtggcacataggctccgccagcttttagaacacccaataaaccgactaccatagccagattgcgttcgacataaagtgccacccgatcatcagggcgtatccccaacgtaattagatggtgcgccagacgattggcacgatggtttagctcgttataactcagcgattggtcttcaaagacgacggcggtggcgtctggtgtgcgctgtacttgcgcttcgaacagttgatgaatcaacgcatactgtgggaaatcgacttgagtggcgttgaaatcgaccagcagttgctggtgctcggtggcgggcagaatagagcggttcccgatcggccgttgaggttcggtttccaacgcctcaaccagccctgtaagagcggtggtcatataggcggccagacgagccggttcgatatccggcacagtctgggcaaccagccggaagccttcacccaaatcatccacggacaaggtgaggggatagttggttctctcctgttctgccaacagacgtatacctttatcttcccacgtggcaaaggttgtctctggttgactatggcgatagttaagcagtgcgctgaagagtggcagggatggtgctacaccactacagtgttgcgccagcgtaagtgatgcctgctcgtgttccagcagcctcgtcaaatcgcggtagaccgtttgtacggtcgtttgtacgctgtttcctgccagccggatccttatgggcagggtattgataaacaggccaaggctccgatcgatgccggcactcccttgcatacgccccagtaagactgtaccgaaaaccacatcatcccgcccgctggttttagctaacacctgcgcccatgcgacatggaacagcacactgggactgataccttgacggcgtgcctgcgtgcggatggctctggccagtatcgcgtcaagtagatgcgtggcttcagtcatctgtctattcccgctgtggacatccagtatcccgaagggtgtggtcggcgcatctacactggcgagcatctcacggaagtgagtttcgtgctctgaagccggtacgctcagggactgggcgacaaaattgcggtaaggctgtgttgcgggtaagttttcggcacgattttgcaacaattcgctgatttcagcgatgataagtcccaaggtgatatggtcactgaccagatggtggaagcacagagccagcaaccactcgttctggattggatcatgggcgatatcgatggagaaaagcggagcttgacacaaattgaggcaccgctgatctggatcggtgtgtgccagcaattgagattggacgtccttgtcactggtcggtacaaatatgtcggtgtgcagaagagcctgacgccagacgacttgtactggctgtgctaacccctgccagtagactgctgtacgcagaatatcatggcgattaatgacctgttgtaaggctgtcaggaaggcattgagactttcacgagtatcgaaagcgagcatgttgcgtaacagataaatatcaccttgcggttgtaacaggtgatgaaacagaatgccttcctgtaatgacacgagtgggtagatatcctgaatattagcggcacctccggggatggtggcggcaagagtatcaatctcgcgctgggacaaggatatcaggggtagcatatcaggtgtgatggtggtacagccgtcagggatgagattgggtggcacgctaaaagcagcaatactgtcttgagcaagcagcatggcctgcgccatttcggccagcatcggtgtggagaacacggtacggatgtcaagaacccaacctcggctacgcagtcgttcgatcaggttcaccgccattagcgaatgaccaccgagctcaaagaaatggtcataacgtcccaccttttccagccccaataatgcttgccaaatctcagccaatgccatttccattttatcggcaggtgcttcgtagatgcgcgctacgaccgccgtctgatcgggtgccggaagagcctggcggtcgagtttaccattaggcgtcaacgggaaggtgtctagcgttacaaaggcgctgggtagcatatactcggcaaggtgctgcgcgagctgctggcgcagttccgctggcaccagttccgcattcggttcagcgagcagataagcaacaagccgtttttcgcccggcgtattttcatcggaaatgtcttcgcgggcaaggacgaccgcttcgcgtacgccgtggcattgcaccagttgagactcaatttctgccagttcgatacggaagccgcgcagcttgacctgaaaatcgttacgaccgaggtattcgatattgccgtcaggtagccagtgccccagatcgccggttttgtacatacgtgctgctggtataccggaaaacgggtcgggcaggaagcgttccgccgtcaattcaggacggttcaggtagccgcgggctacgccggcaccggcgatatgaatttcgccgaccacgccaagaggaacgggctgcccatacggatcaaggatatagatacgagtattggcgattggacggccgataggcggagtcctttcttcttggttatcgcacagataaatagctgaacagacggtactttcagtcggcccataggcattaatcatgcgtcgactggtagcccagcgtttgaccagtgaggatgggcaggcttctccacctacgatcagggtctgtagtgtcacaggaattgaatccagtgcagctaacgctgttggcgacagcaatatatgggtaatggcattggcttccaaggtatccgatagtgctgtaccgggtaggagatgtatgcgatgggcaagatggaggcaggcacctcctagtagagccatgcaacattcccagatacaggcgtcaaagctgtttgaagcaaattgcaggatatgactgcctggctcgattgccagaacatcctgctgtgtcgagatcagattactcaggccgtgatgctcgatcattactcctttggggagtccggtggatcctgaagtgtagatcacataggctaaatggtgtgacgtcaggccgagtgcctgcacgtccggattatgggtcggttgcgttgccatggttgattctggctcgttgagcaccagcgtaggtatggtggtgctcagcgtgtcgagcagcgccgtctgtgtgagcagaaccatcggtgccgcgtcatcaagcatatacgccagccgttcggcaggataggccgggtcgagcggcacataagctccaccggccttgaggatacccagtaaaccgaccaccatatccagactgcgttcgacacacaccgccacccgatcgtctggacgcacattcagcgaaatcagatgatgagccagacgattggcgcggcggttcaattcgtcataacttagggattggtcttcgaagaccacggcgatggcgtcaggattgcgttgcacctgtgcttcgaatagttgatgaatcaatgcattttgcgggaaattggcctgagtggcattgaaatccaccaatatctgttggcgttcatcttcgggcaagatgggcaaattcactatcggcgtatccagagcggtgatggcggcgtcgatcaagacggcaagacgagattggagagccatgacctctgtggtgctcagataatcggtagagaaatcgaattcaattgtgatggattgaaggtcatcgtcaagaccggttgtgtactgttcgatgatgatcgaaagaggatagggtacaccatggtgtatatccactaattggatattggtatcttctcctgccatatgcaggttagctttgaacggttcgagtgacaatgtaatgtcaaataattgaacacgccccgttttctgctggatatgtgtttgtcggttgatctccgaaatgggcaaacgctggtgcttatagcaacgacgcaattcggtagaggctttgtgcataacatcaaggaacgtgtcttctggcgaaattgttacgccaatcggaataacggatgcgaacattcccatagtgcgtttttgttgggcatttttacggttgtgcacgggaatgccgatgacaatttcatcctcccccgtcgtccggctgaaatagctagccagaacggcatacataaaatgcaggatagataatccttgccgggacacggtgtcttcgatacgttgaaaaagcgccttgtctacttgccaaagaataggtttggcttgtccgtgattttctgctttgttggaatttgctggtgggagtaatggcggcggcagactttcatagcgtttcacccaaaattgcaaatcgtgtgagtagcgttgagaagccagataatctcggtcatccgtaatgaaattcagataagaaggggcagttttgttcagtgtttctcccctcattaggcgattgtaggtatcgataacatcttcactgagtatggataaactaataccgtccatgatcaaatgatgacagcaaaaatgccagtaccgacgtgtatggctcacccgtaataattcggtacgccatagtgctccatccaagtgaaacggacgcatgaactcggcattgatatgttgtttggcttgggcttctgcgtcgatatgcggagataaatcgtgtatgtctatggacgcagggagcgtaccagccacctcttgcagcggtaaggtgtgggtgttgatgagctgtaaacgcagtgtgtcatgacgataaacaacagcttcaaaagcacgagtgaacaaggcttcatccaattcaccatcgatgcagataaaaaaaccgatattgtaattgggagaaccgggatggataacctgatcgagccagatgacttgctgaggagaactcaacggatgtacatgaggaagaagagtgttgttgttatcaacggctaaggaaatttctgaggagcgattttggctgtgtgacatactcatttcccctttgtaatagttaagactcactgatatatgaaaaataattactgactttgattaacttaatgcctggatggaaaacgaacttaaaacatatctaaaaataagaatttttgcctgaaaaaatatatagcaatgagtaattatagataaattaactaaattaaaccctggtgtcgatattttgttgctgacggaaacgtcgcaagggggtatgttggggtgaatgaattgtagttgtatgattattaagaaaaattagctagataaagaggataaatatgctgtctcggattaaaagcaagtggttgttttagcagctacttatacgataattattcgtttaattgttatcgttctctgggcaacgaggtaaaattgcagcctttcgaacaatctaaccactaaaaggatagcccaagaagtgaaaaggcctttgggctgtgtttggcggatcgtcttggagatttgcgtttattgataggtcaacgtaatagttgccgttgcatctgctttgcctggtgccacccgtccttctgtttggatataacgggcatgcagtggaatagcaaaatttcttattgcttggacggagtgaatcataagcggagaacccattgataacggttgattttgatataagatctgtaaaccaattccggttgctgtgacgttgtcactattataatccaatgcccagatattattggcattgctttttgcaggtcgtccatccagcgttacgccgactttaacattggcatcgcaatccagatttaattcgaaatttcgcataccggctgtgctatttatgccgcgaaatgcactggttctgatttctcccatattgacgaaggtcgttttttgcttgagggaacatccctgagtcatgatataagtatttgtcaaaaagaaagtatgaatagggagattgagtcccaatttggctttggttagcagtttctgatgagttggccccgaaccggttgcgggtgcaattttgattaattgaacggtcaaataaccccatgttcggccacaatattgctttttattttgaaactgacgcggcggggaacaagtgactgggtatgttgctgttctgggtagccaatcaataccatagccgggagcccatgtattgatacggataccgacacccggcactccagattcataaattgcatcatagttgtagtgtgccggatcaaaatccggtttctcccatgatgtaggagtgagcgtattacagatggcgatatcgcctttttcatccacatgatccagccgaatttccttgatggttgttccgataggatgatctctaggaataacgatagtgccaaaagagacgtaggtagtgccggctgaaaaccccggcgaatattggcagtcataatttgccagagcatcaaaactactcattatgcccacgataaacgtacttgctaataataattttaagccgctaatcatataaaatttccataatataaaaaatatcaaatagatgttctggtattgttattcacaggccgcattcaccatgtacaaacctgatatcggtatttcatcaggaagttgataattcacatgacattcctgaatatctttgtgtccccatttcacccataaccgacctgttttaggaacaccactgagataagcctgtccatcattactgatgatggtgctgttggtgtcatcgatgtcatgttgtttttccagtgttgctgttgcgccaaatggaatctctttacctttatgggaaagcatcatcaaaacgcgatagccaatacgggtttggaaattggctaaagccaatgaaccttgggttgggatgatggtttgtgtattgatatcaatatcaacattgttgcccattgaataagtatccagagcaatacggtttttacgataactactgacataagggacgatggcatagccgttccagtctgttgaaataccggtatgattctgaactttaacccctttggcaccatgggcacgtactaatgccagtgtatctcccaatgattgggaaagcgtaacaccgtaaggatgtgcaacaatcccgccatttaagccgtaattcagttgcttggattgtttatcgtaattgtaacccgcgttgatctggccatatgcacctttatattccgcgctgatattcccgccaatatctttatcgtggtgggtataattttgctggatactataaatcagattgttatcttccagggctgtaccattgagactgatctgatgagatgtatccctgtttttactattggtcaggttataacttacccagctatttttcagccagcgatcaagcgggatttgcacactgaatgataaaatctgatcattgtgttttgaaccggggaattcactgtaggtataattcagattgtaattaattgaatgataactggtattgtaacccgcgctgatgttccgttcgtaaccttgttgataccagtaatcttgctgaaaagcagatagataaacgcttcccaaattccccagtgactggttgatgtgtagttgcaatttactgcgtttattggtgttgctgcgattgtccttgttgtttgtaatatcgatctcattggcgtccttaaaatcataaaagcggtgagttgaataacgataacccgctaaagtgaggttggtacctgtctgggaaagatcttttgcatactggaaacgatatgattgccctgaatcactgatattttcagctaaatctgattttgcatgagtgacatcaaaggatagagagccccaatcagaaaagctatatcctgtaccaaaagcagcggattgataatcttttgagagggttgttccaccataaaccgtcacacggttggaaataccatatatcaccgtaccctgcataaaataaggttctttgccacgatgagtgaaagattgatatttccccagagtcagggaatatcgcaaactattctcccgtaacatgataggaacggctgaaaaaggctgtacagaacgatgttctctcccatccgcttctttgataatgatttccagattaccactggatgtggttgggtagagatcgctgacgacaaaaggcccggcagaaacataggtttcataaatgatataaccattctgtttaatggtaacttgagcattactttgggctattccccgtatcgtgggcgcaaaccctttcaggctatcaggtagcatgttgtcatcagaagccaattgcattccccgaaactgaaaaccatcaaaaatggcggaaggtgtataactgtcaccaaataccaactggcttttcagggtatgaacatcacgttgcaggtaagtgttaagactttgccatttgtggttttggctgctgtaagtagagtaattccgcaaccgccatgcttcccaattggcgcctgttctaagattgagaaaattattacttgtcgatccgggttgattattcagccaattggttgaaccgctatagttataattaaccagcagagaggttaacccctgttcccacaaatgagatgaaacataatccctgacttggctattcagagcagcttggggaatactgatatcaagccgctgcttattgaagtcgaaaaaagatgacgcagatggaatatgctgcccaagatcggctatttctgtttcttgtggtaaatcacgcaaagagggaaatgaatcaatatttacacccatcttctttaaccgctgtaggttaatcttcggcgatagcttatggtttacaatgataaaatcgacatttccagtgtctgctttttcccgattgaggtaaatatccacccaatagcggccgggtagttgctgatcatcttgagtgaaaattgacagatcaatatcttctggaaagccggagtgagtttccaacgcattaatattaaaatattcttcaccataagcctcattataatgagtgaaaagccatgtgattgtcacagcatataaaaacactttgcttggcttgataaataataccaaattatcagaaatgttatgttgaagataatgacggtagttatccataatgattttctaaccttgatagactgtataaatttatggtcagaacatgcgtttttcttctggcgttacaccgccaaaatcattgatggttttccaagtgacatagttgatatttttaatgggaatatcccaacttaattgactataaggcgatatcataccagcgggtttgatttcatgatttattgaattatttccagtggttagatcagaaaatgagatatagtatggtgttgggttctctgcgattagcttatgccctacggttttaaacttcagtgctttgtaggcaatactggcgttgtctgctaaaccgacagggcgataaaatagcttaaagcgagatttcacggtgatttgcaattgattctgatctgattttactgttcccgggatagacttgacattaagccagaaaagagattctttatcatttggcaagttttcgccggtttttacaattcgcagaatattctcattcccggcggttaatttgaagagtgggggagtgataataaaaggaactttggtttcattattttcatcctgaacccatgattgaataagataagaaacatctgtttcagggttgctaatggagattgatgcttcttttcggtcactaatatacacaatgcgagtgccaccgataacgacaccagcaaaagaaatattgatactgaaaatataaagaataataaaaatacgaaaatatttcaaaatggttgctccaaacaatatattattatttttcatattcattgatgatattgtattattgtggcatccctgccataaggatccttagttgtagacaatagtaaagttggctaccgcatcaccggaaccagggttaacagttgaatttgtagcaatatatttagcaataaaatttaactcttgtttggacttattagtcagtttctgagttatggatgactgcgccagagaaataagagttgcgctatcggcttcataaagaccgagtgcaactccgccagccgcttttttctttgaattgtcgttgcttaatgccaaaaggttattatttcggctgtccgggtttccatcaaatttaacttgggcataattagcttctgtaggacagtcagtcagtatgatactgaaacgcgttgcagctgatgtgctatttaccccattgaatgaacttgaactgatagtacccatattaacagtttggtttgcagaactaggatcaattttacatgcagtcgcggtaatatcgcctgtaaatttgatttgtccatcggcggcatatgctgccgatacaagtgcagatgataaaaataaagaggaaataattagattggttttcatttttaatatattccacctctgacgaattgatacggcagagatatagattattgagttaatagtaaatccgtacaattatgatataacaagtaatttgtccgaatttataccgaagcacgataaagaaacgttaaatgacgtttctttatcgacagacatttcgaagaatatagtagcgattaattgacaaagataaaaataataactcgacataagtcattatttgaatcttttaactattaagtaaatattaatagcattgttattcagaaaatggaatgtttctccacccgagatgaacgtttattctgttttataagattaattattagttgataaaattccgcgaaaatgaatacgattttaaacgtgtttatttttgtaattgaatacttttaccatatttttaactaagtattatttatttgtgacaaaatgtttcctgggtaacttaaatgctataaatttagtatttgttagagcttacatccagaataaagatgaatgataatttattcatccaattaaagttaactctttgttaataataactagttcagcatgataaaaagttattttttgtttattaattaataaaaatacatcatcaaggaaatagtataaatgtttatggattgcataactatcatccatatttcttttgttttagttacaacatacattttaagcttaaaaaacaaatcccataaacaccgcaaaaaaaagcttaataagggttctatttcaaccaaaaaaattaaggagagaagttgatgattctctccttaggggatctaaataacttatatagctatcaaaaaatacataaatgattaatgtattagtagccatgtagaagggatagtcattagtattaaaatcacgatagctgttttttccagcatattcagtggtttttgtccttgattctgtctacgtgcatacaagaaaacaagcaatccaggcgcatacaatacaactgaaagaagcaaatgcattaaaccagatgcataaagtaaccacacaccataagtacaggctcctgcagaaatcaacaacaaaatccggttgctgcgctgaaatgccactttggctaaaaatgcaccaacgagaaaataggggacaagtatcatttccgaggcaatggaaagcaacatattgtaattgctgccacttaaccagattaaaatcaaggaaatctgaacagctccattagttatccacagtgatgactcaggcgcttttttagtgttttgtttattgaataccttaggaaatgagccatgcaaggaagcgatgaaagggacttctgcggccataattgtccaactcagataggcaccgcaaacggaaatgatcaggccagcaataataacaatttcacccgtagagccaattaaccctaccatcagatttgccattgaaggattacgcattgccgctaattcaggtcttgctaccaatccaagagagagcagggtaaccagaatataaacgcctaatgctgaaacaacagcgagaacagttgcaataccgatatctttgcgctttttggctctggctgaaacaacaacagcaccttcaacaccaataaatacccacaaggtgatcagcatcgtatctttgacttgttgccagacaggtatccccatttcaatgccagtgaagtcaaacgtaaatacatccatgttgaatgcaatcacggccaaaataatgaacatacccaatggtaacaatttggctaccgtggccaactggttgatactggctgcagtttgtactcctcggagtacgagccaatgaacaaaccaaagcaaaatagattcaccaatcagagattgccaggtatttccatcaccgaaaataactgaatattcggtgtcagtaaaaaaacttaatgccgcgaagacgataaccagataagaaacattggcgataatggcacaaaaccaatatccccatgcagaacagaaaccaactaattcgccaaatccttctcttgcgtaagtaaaaattccactgtcgaggtcagggcgaagacgtgaaagcaatagtaaagaagtggctaaaaagagaatacctacgcctgtaatcccccaaccgatcattaatgcagcaggactgcctacttgtgccatattttgtggcaagctgaatacaccggctcccaccatggaactaagtaccagtgctgtcagagatgtgaggcctaattttttttccaaagataggttcctgaaagtaatataatcgacacgattagtcagaacgcttgttctgactatcgaacacatattggacatttattgcatccatactctggattgcacagaagattcagtcgttaaatccaaaaacagggcgattctacggagtgaaaggattgtatgcaatgggtgactatgcaaaaaaatataaattttatgcataaaataatgtacgttaggcgggatataaaagaacgaattattcaaaaaacgtattttggcaataataaaaaggcacaaatgatgatttgtaccttttccatcaataacagattaattatttgaataaatcggcgctgacagtaatgttaccaccattagattgccactctctggtgacatggtagtatttcgcacctttttttgctgcacgtttagcaacttgataagaaatttctggatctgtggtgtaatagccagagaaagtaatcgagtcaaaaggaaccatttgagcggcagatgccttattcaattcttctatttttgtgccatcagataacgtgaccgtgtaacgaccaccttttgatgactgggtttcaaaaaatcgtccaaccaaattgctggtagatgttgaggaagcaacacctggaatttcaactttctcggcttcttcgccgccttgagccagagcctgacggccagcctccgaatctgctggaataaccgcattattagactgtatctgacgttttggtgcatctgttttataaacatatgcagtaactatttggtttcctccattattgggagaaatatcacggacaataaagaaagaggcagcatctttctttttagcagccttagcgatggcctctttcagatcaggagcagtagaaaagtaaccattcacggttacggtatcaaaaggttccagcgtaatggcttcagttttaggcagttctttaattccacgataaatgcgatagttagttattttatcggatttttctgcatctttatgatacaaatcggctacaacacgtaaattgccaccaccattaaaatcgtcgagactttgaatatagaaactataggcgccttttttatccgcctgacgggaaatcgcatcagcagcttcatagattgcattgaaacggccagtgactgagattcgttcaaatggcttcagctctacagcttgttctggcgttaattctttagccgcatgtgcagcagtaatcgttgttagcgagagcatcgctgtagcgatgatcgttgttttcagcttcataaaaaatcctttcgccttgcgcattaaaatatttataacgtgctgaacattgttatgtatcacataggccgcaattattacatgtaataatgccaattgtcgcaaaaatttatgctatctaaataaatgagtattagtttttagtacatggtgccagcaatttaaataaaaatagcgatttatacgagcgatagcatcgtttacattgaaggtcactttattttttcctgatattgttttcaattagtgactattttattttttattggtaggttttattgatagcagtaataaaatcaaccttatcgttaaattggcttcaacaggtaataatcagcaatatttcattcttagagaaggaaacattatgcatattggtgtaccaaaagagcgactttccaatgaagctcgcgttgctgccacaccatcaacggtggaacaactgcgaaaattgggattcagcgttagagtggaaacaagggctgggcatcttgccagttttgatgatattgcttatcaaaaagcaggagctgatattgcagaacatcatgaagtttggcaatcagatattatttttacagtgaatgctccggaagataaagaaattgccctgatgaaagaaggggcgacgctggttagttttatctggccagcgcaacacccagaattaatggcaaaattgtcaaaacgtagagtaactgttcttgcaatggatgctgtaccacgaatttcccgtgcgcaatcattagatgtcctcagttcaatggcaaatattgctggttatcgggctattgttgaagcggctcatgaatttggacgcttcttcactggccaaattacagcagcaggcaaagtaccaccagctaaagtcatgattatcggagctggtgttgcagggctggccgctatcggggcggcagggagtcttggcgctattgtccgagcttttgatacccgtccagaagttaaagaacaggtacaaagcatgggtgctgaatttttggaattgaatttcaaagaagaagctagcggtggtgacggctatgcaaaagtcatgtcagaagcctttatcgaagcagaaatggaattgttttctgcacaagcacaagaagttgatattatcgtcacaacggcattgattccgggaaaacccgcaccgcgactgatcaccaaagaaatggttgagtccatgaagcctggcagtgtcattgtcgatttagctgcgcagaatggaggtaactgtgagctgacggaggctgataaactcattgtgacaccaaatggtgtaaagatcataggctatacagacttgcctagccgtttacccactcaatcgtcacaattgtacggcacaaatttggttaacctcgcaaagttattgtgcaaagagaaaaatggcgaaatcactatcgattttgaagatatcgttgtacgtggcattaccgtaattaaagagggagaagttacatggccagcccctcctattcaagtttccgctccacccaccaaacctacgacgctgaagaagaaagaagataaaccagcaaaaaatccgaggtctccatggttgaaatatggtctgtttgctcttgccattattctgttcggctggttggcaaacgttgcaccgaaggagtttctgtctcactttaccgtatttgctttgtcttgcgtggttggttattacgtcgtctggaacgttagccattcattgcacacacccctgatgtcggtcactaatgctatttcagggatcattgtcgttggggcagtcttacaaattggtgaaggtggatgggtgagttttttctcattcatcgcggttttgattgccagcatcaatatttttggtggtttcacagtcacccaacgtatgctgaaaatgtttcgtaaagggtaaggggtaacttatgtcgaacggagtagttacagcggcatatattgttgctgccattttatttattttcagccttgccggcctttcccgccatgaaagttcgaggcgaggtaatatctttggcatagccggtatggcaattgcgctgattgccactattttaggacccgatgctggcaaagtaggttggattattttggcgatgatcatcggtgccgtcattggtattcgcttggccaaaaaagtggaaatgaccgaaatgcctgaattgatcgccatcttgcacagctttgtcggtctggcagcggttttggtcgggttcaacagctttattactcatgatatttttgctactcccattatggaaaacattcacctgacagaagttttcttggggatcttcattggttcagtcacctttactggctcaattgtggcattcggtaaattgcgcggcaaaatttcatccaaaccgctgatgttaccccaccgccataaactcaatttggccgcgttgattgtttcctttgtactgatagttatctttataaaaactcaaagtgttggtttgcaagttttcactatgctagtgatgactgctatcgcacttgctttcggttggcacttagtcgcgtcaatcggaggggcagatatgcctgtcgttgtttccatgctgaactcatactcaggctgggcagccgcggccgctggtttcctgttaagcaatgacttgctgattgtgaccggtgctttagtaggttcttctggtgcaatcctttcttatattatgtgtaaagcgatgaaccgttcttttattagcgttatcgccggtggttttggtactgatggtacttcaacgggggatgaacaagagatgggcgaataccgcgaaacaaatgcggaagacgttgctgaactgctgaaaaattccacttcagttattattacgcctggctatggtatggccgttgctcaagcgcaatatccggtacatgacatcaccgcaaaattgcgtgagaagggcgttaaagttcgctttggcatccatcctgttgcgggacgtttaccgggtcacatgaacgtgttgcttgctgaagccaaagtttcttacgatattgtcttggaaatggatgaaatcaataatgattttactgagacagataccgttctggttatcggagccaatgacacagtaaacccagcagctcaagaagatccacacagtccgattgctggaatgcctgtactggaagtttggaaagcacaaaacgtgattgtctttaaacgctccatgaatacaggatatgcgggagtacaaaacccgttattctttaaagaaaatacccagatgctattcggtgatgcaaaagccagtgtcgaagcgatcctccgtgcactgtagttttgtaaaataataatttgatattagagagcttcatgttgtggcatgaagcttttttaatgaaatatacaaattaatccgggctaaatgaaacttgcttcaatacaggacgatccagacaggagttcgagttaccgaaaaacaacacaatatcaggttgaaaacctatcttacttatcgcattacctcgttgaaaaccgccgtttcaaacgcaaactacagacgttattgttaccaagcaactaaaaaacaccaataaatgctcaataaatatcctacttattaaaatatacatttgaaaaagtagcttttctacaataggattgtattggtaatgagccacattttttacatagcgaaatcataattatgctcaaaaatagggctaataagataagttccattatccgacacgcttgttttgtaaaaattcgatttgagcttgtttgaacggaagacattgaaatcagcaacaaggaggaaattttgaaccaccaaaacccagatgaatataacgatggaagtgatgaagacacaaaatcatggatggtcatttcaggtaatcaacaaaagcagagcatgatcatgccattgtctgtatctggccagcagatacataacaatcccgcgattgcatatcttgttagtcttggctcaaagcgaagtcgccagactatgaaatcgtttcttaatattgtggcaaaaatgcttgggtatcaaaatgtacaggactgtacttggaatgcactacgtcgccatcatgtgcaagctatcatggaaatgctctccgattccggcaaagctccagcgacgatcaatacctaccttgctgcgttaaaaggcgtggcgctggaagcttggacaatgaagcaaatcgataccgacagttttcaacatatcaaacaagtgcgttctgtcagggggaatcggttgccgaaaggaagagcgctcgaccgttatgaaatcaaaacgttattttttacttgtgaaaatgatttcagcacaaaaggcttacgtgatgcagccatcattggtgtacttgtcggttgcggactccgtcggtcagaaattatctcgttggatttgaaacatgttattcgtcgtgaacaagcattgagagtcatgggaaaaggaaacaaagaacgtttatcctatatgcctgaaggaacgtgggaacgtttgaaccgttggatagatgaaatccggggtgattatgccgggccattgtttacccgtatccgtcgtgatgatgatgtaacagataaccgtctgtcagatcaggcaatctatcacatactggaaacacgtagaattgagagtggactggaaaaatttgctcctcatgatctgcgtagaacattcgcatcagccatgctggacaatggggaggatattgtaacagtgaaagatgcaatgggtcattcaagtatcactactacccagaaatatgatcgacgaggcgatgagcgtttaaaaaatgcagccaaaaatttgaatttttaacatggaagataagatattttgaaattaaacccgtaataagttttattatttatactccatgttttacaggcagaaaaaaaccagtctcataaaggagctggcttttagaaaatcagagaatagagctgctcagaaaaaaaacaatcagttactcttcatccacactaatcgggcaaacaaaaccatctggtttaattgccagcaggtcacatttaagcttatcgatgacatgttcagccgtattaccaagaaatgcagcggataacccagttcgcccaagaatgcccagaacaaccacccccgtattcaattcatcacaaatttcaggaatgactttttcaggtagtccctcgtgaacatgagtctgttgttcatcaatatagaatttttgccgcaactctttcattgcaaccaaatgctgcccacgtaatgcctgattatatacactaggattaaaatcaggcaattccattgcaatatttaaaggcgcggtaggataagcgctgacaagatgaatcagaggttcttttacaattcggttagcgagatcttgcgtttctttcaccaatttcagatttagtgcagtatggtaagattcttcattcgataaattaaccgcaacaacggcagaatctttttctggccaggcctgatctttaaccatccagacaggacaagggcatttacgtaatagatgccagtccagcggcgtaaaaatcatggattccaataaagaatgctgatgtgccattttcaataataaatcatgctttcctgtgatgacttcctggataatggcttcataagggtggccatgccaaactaccttgatttcaatgtcaatacctgattcaagatagtagtgtgcctgcttttttatccaagcaattctttggccaatgacacctttacgcatggcatttctttcttctggagaaagtaaggtggtcatttcatatgagaggtcataaatgggtaaaaatgctttaatccggccaccattacgttgcacgatatatactgcgcgtcttaatgccggctgatcatcctgatttgggtcaattgcaactaagaggttttggtagtttgccatatttaattcctcacagaggctggatatatctttgtaagaagataaaccaatatgaccaactataacagggtaaaagaaagccagatcagcaaaatatagcgatccggcttaaaatttaagaaaactttaggacacgcaagcaggggcttttcctgccaattccgtcagtttctccatattttcgaccgcaatgtacttacctttaacacctaaaatgccatttttctggaaacggccaagcaggcggctaattgtttcaacagtcagaccaagataattaccgatatcgccccgtgtcatggtcaaacggaactcgcgaggagaaaaaccacgctgcgcaaaacggcttgacaggttatagataaatgctgcaagcctttcttccgcattctttttggatagcaggaggatcatttcctgatcgccttttatttcgccgctcatcaagcgcatcatctgctggcggagatttggcatcttaccggaaagatcatccagtgtttcaaatggaatttcacacaccatggaagtttccaatgcttgggcaaaactgggatgctcagtatttatgattgcatcaaaccctactaaatcgccagcaaggtgaaaaccggtaatctgctcatcgccttcttcagtgatcgtataacttttgatagtcccagaacggatagcatagagtgattttaatgcatcaccagccttaaacaaagtttgccctttctggattggttttttacgttcaataatattatcaagctgatcgagttcatgttcatttaaggtgaaaggaatgcatagctggctaatgctgcaattctgacagtggattgcacaaccaccagattgaatccgacgaataatacgtttttccgggatcatagggagtgctcattagaagtgattgatatacgtcaatttaacatatttaaaacgctctgataagagctagattctcttattaataactgtataaatcatcacgcaaaaatgtaaccgccattctaccttgattgggtaactttccacttccccctgttctacataacacagttagtgacggcgtcacgttttttgttaggtaaaacatgctcacattcatagtctcgaaatgaaacctttccatattcatatcactccgcattccgcacatttatttgttgtagcgcacaaatttgaaactatttattaacttatgattaatattttaaaaagtatgttttatatcgattaaaatagattaatttgatatgtgttaatgaaaattttcagcacactcattaagaattaaataatttaatttcaattagttattgttatttttccttttgtcacaagaggtgcgccattaacgtatgaaacaaaaattataacattaacaaatttataaacgcataaattgaaaaatattataaaacactaagaaccagcaaaaaggtatcgtgattatgactaagcctctttataccaacttaaatgtagatgcgttgtttctaggcccaaaatcagaaaatgcagtttttttcagagaaatgatggactatgcagtcagcgaacacatgcactggcgttcaggatttcacccagaagatgctaccttggttacatccgttgatcgttatgagcataattacagagaaactctctatcggacagaaggaatattgaatcaactatcagcaaaactaaaaaacacttcgattcctttcttctccccccgttatctaggccacattaacagtgacactttgatggtttccaatctcgcctatgtaatggcaatgatgtacaaccccaacaattgtacctacgaagtatcacccacaacaacagaactggaacttgaatccgggttagatctctgccggatgcttggttatgacccccagcgcgcatgggggcatatcacttccggtgggactgttgctaactatgaaggtttgtgggttgccaggaacttaaaaacattgccttttgctgtatcccaacatcctgagacaaaagagttggttagtcataagtcacaaaaacaattaatgaatatgccaacagctgaagtgctcgatttaatcagcgaattacaaagacgtggaattttcgatgaaatacgtaatatgacatgtcgtggtacagggagtaaaactgaaattttaggtaaactactcgtaccacaatccaaacattattcctggatgaaagcagcagatattttggggatcggtcaggaaaatattatcccattgcctgtgaatgaacactatcaaaccgatattggcaaaatgcgtgaaatcacctttgatttaatcgagaagggtgagcctattttggcgatgattggtgtagtcggtacgactgaagtcggtgccattgatcggattgatgaagtgattgcattgcggcaggaatgtgaagaacgttatggtgaatcattctatatccatgttgatgctgcttatgcgggatacgcctgttctatgcttctcaatgagcaaggtgaatttatggaatatgatgatctggttaactatcatcacacgctaggcatcatacctgaaaatatcagttggccaaaacctgaggtttaccagagcttcaaggcattgcgatatgtcgattcgattacagttgacccgcataaggttggatttattcaatattcagccggggcaatttgtatgaaagacaaacgtattctcgatttgatttcttcacgtgccctttatgtctttgaagaaaatgacaatcaaagtaattttcctgccagtaaccgagggatacttggcgcttccataatggaaggttcgaaagcgggagcaaccgcagcagcactttgggccgctcatcgattattgcctttaaacatcagtggttatggaaaagtgatagccgctggcatagtcaccgcgaatcaactattagataaaatggcaaatatgctccccattgaagtcggtgagtaccggtttaaaatgtatattatgccaacaccggattttcacatgatcaacttcactttcaaagaagtcggaaacgccagccttatcaaccacaatgcacttaacaagcgaatttatgaactgtgttcatattcttcaggacgtgcatatagcaacgattttctcacatcttcaaccatactggattacaaagagtacggtgatacaccgtggtactacgccgaaaaatgtggctttagccgtagtgagtgggaaaacacacaccgtgtttatgtattacgtgcggcagtaatgacacattgcttacgcaatccagagcacttcgatgagtactggaaacaactacaaactattttcgccaaaaaattaactcaattggttgatgaagaagaaaaaaaatcacgccagattttgaatcgtgaggaatcttttcttaattaaccaaaataactggcattggtgtgaacggttatttatttttacaaactagaatgaatttttaatcatagttttatattcagaacatatattgattgtcaaggcttggagagtaacgcttccaagccttttttattacttaataacactaaaaattaacgcaataatgataattaattttcattttagatatgaatttttatcaaaaaaaacaacaatatttcagtgactcttcagtgatcaggtgtttaaatcaccgttgtatttctaaagcagaggagtgaaataatgccatttacgctcaaacccgctaaagaacactttggtgcatatgtgacgtgccagaatgtttccgaactgtcgtttgaagagtatgaaatactgaaattgcatctatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactacctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatattttgcccgcagcgctggtcgtgattgcggaacatgttggtcatctggtcgtcacggctaatattgtgcagaaggatttattgaaagaccccggtctgcaccgttcgatgtttgcgaatggtttttcaactatgatttcgggtttttttggttcgactcccaatacaacttatggtgaaaacattggtgttatggcgattacccgagtgtacagttcatgggtgattggtggagcagcgatactggccattctgctttcttgtgttggcaaactggctgcggcaattcaggtcattcctgtcccggttatgggcggcgtttctttgttgctatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagtaagcgtacggggaaccccacctagccaggataaatccattgattaaaatagtttcacctattctgatgatggaaaaaactcacatgagccaatccaggtttactcaagccgagtggcgggacctgtttgaacagcagaaaaaatccgaactgactgtcccgcagttttgccaaaaaatcggtgtgtcgacaacccggttctatcaccaccgccaacgcacctcccatccaccagaaaagccgtctgggctggcttcaccgtctgcttttattaaagtcagcaccgctcagaaaaaatccgcctcatccagcatactccccatcttatttgagacaccacatggcacactgcgttttcctgccggcacggataagcatgttatcattgcgattattcgggggctcgccgcatgaaaatgtttgtggatgtgccggaggtgtatttgtgccgctcatttatcgacttccgaaaatccatcaacgggctggcggtctgggtggagctggaaatgcaactgtctccgacgcaaaccgcgttattcctcttttgcaacaagaagcgggataaactcaaaatcctctactgggataaaaccgggtttgcgctctggtacaaacggctggagaacgcgaaattcaaatggcccaccgccgtcaacagtgcctccctgaccctgacagagcagcaactgcacggattgttatcgggttatgatgtcatcgggcaccagcccttctccgtacaggattgccatgtcgcctgatcccttgatgatcatcaaaccaacgggcattaattacgctttttcgccggggatggcataaaatgtccccatgaaaattgatattgatgccctgcccaatgaccccgctgaactgaaacggctgctgattaagcagtcgcagcggctggcctttttggaagagcagttccgtttagcccaacaaaaacggtttggggcttcctcggaagcgttccccggccagggggagttgtttaacgaagcggaagaaattgcgctgccggctgaaacggccgccgcacaggaaaccctcacacctccccgccgtaagccgacacgcaaccccctgcccaaagatttaccgcgcgaaaccgtgttccatgatatcgccgaggaagaaaaacagtgtgcgtgctgtggcggcaggttgcatcagatgggggcagatcgcagtgaaaaactgttgttcattcccgctcaaatcagggtggttgagcatgtccgccccaaatacgcctgccgtgaatgtgaaaaatccggcattcagacgcctgtcaaacaagcctccttgccagcgatgcccatcaagaaaggcatggcgaccagcagcctgctcagccagcttatcaccagtaaatatcagtatgggttaccgctgtaccgtcaggaaagtgtgttcaaacagtatggcattgacctcagccgccagacccagagtgactggatattaaaatccgcacagttgtttacgccgttggtggccaggttcagggaaatgctgttgcaacaaccggttctccatgcggatgaaaccccggtgaagggggtgacgtctgaaaaaacgacccattacatgtgggtctattgtgtgggcactgatacccccgaaccggcggcgctcacaccgaatattgtgctgtatgaccaccaggccagccgttcaggcacctgcgctgctgactatctcgccggttttcaaggttatctgcaggtggatggctatcaaggctatgagcagaccggtgcccggctggtcggttgcatggcccatgcccgccgtaaatttatggaagcgaagcaggcgcagggaaaaaacaaaacgggcaaagccgatatcgcgctgagcctgatccagtcactgtaccgggtcgagcatcaggtcaaggggttaagcccggcagaaaaataccggatccgccaggaaaaagcgcttcctatctgggataagttatcggcctggctggttaaaacccgatcccaggtgatccccaaaagcaagctgggtgaggccgtcacttatctgagcaatcaatgggcaaaactgatccgctatcgtgaggatggccgcttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtagtttagttgacgcttaccttatctgagcaatcaatgggcaaaactgatccgctatcgtgaggatggccgcttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtagtttagttgacgcttacgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatattttcctcaattgataacttgtcgattatttccgcactaataatggaagtcgattcaagaatatcggcgtgagaacggtcattaattaatttaatcactaatggattcaccatccatgccgaaatattattatccggcatttttgctattaattgatttaccgttaatccgatatctcctttatactctgtattcatttgacctgctttaaataaagtaatatttgtatgcattaattttccacccaaattacaattaaccatttggtgttcaaaaggcattgcactcagtactttattgatataagcattatcagcacctattttctgcaattttatttcagcctcattaagtgcatatgacatatctaattgatttttaatttcagttaattgtgtcgtattaattattgtatctaataagaacaactgaatatcttttgcaccgatctgttctaattgaaatgcaatttccatagctaattgccctcctaatgaccatcctaaaattttaataggtttatcaatagaagtttccgtcaaaattaattccaaatagattcgggctatcttctgtagtgactctatatgattatccgtaaaaagattataattatcgatacctatacagttataaacatcagacaatgcttttgctaaatcatcatatacctcactaccacaaccagccgcatggatcataaataacttattcgttgctattgattctggggttaataaattaagtaaattatattttaaactccctgtttccagccattctgttaataacgaaatacatttgtgactaaacagaatgctcaaaggaatatcaatttctgtttcacggagaatagccgctttcagcttaatggccatcagggagttaccgccgatccggaagaagttatcctcaatgccgacccgctccagccccagaacatcctgccagacagcacacagccgggtttccagcgcattgcgcggcgccacataaccgtcccggctcacccacaccggtgccggtaatgcccggcgatccagcttgccattcagggtcaggggcaccgactcaatccgggtaaaactggccggtaccatgtagtccggcaggcgggcagacatgtaccctatcagtagctcatccgacagtatcccctccgtgatcaggtacgccgccagcgctttatttccctcatgctcgcggtcaatcaccaccgcctgtttcacctgcggatgcgcggccagcacgctttcaacttctcccagctcaatgcggtagccgcggatcttgacctgaaaatcattgcgcccccgatattccagattgccgtccgcccgccagcgcaccagatcgccggttttatacaggcgggtgtagccccgcgcctgatcttccgccgtggcaaacgggttcgccacaaaatactctgccgtcagttccggccggttccagtacccgcgggccactcccgcgcccccgatataaagctcacccggcgccccgacgggggacaggttgcccccaccttcacgtacatacaggcgggtgttatcaatcgcccggccgatcggcacattgccattaaattcaccggcagtatcaaaataggtgacttcaatcgccgcttccgttggtccgtaaaggttaattaaggcactggcacccggattaatcgtcttaaacgccctgacctgtgatccggtcagcgcctccccgctacagaaaacataacggacagtggccgccaaccgctgatttaaggcctgtaacgactggcagaaagcactgagcattggcgggataaagtgaaccaccgttaccccggtttcctgcatcagtttatgcagggtttccggctgtctgtggctgtcaggcggggcaatcacaatacgggcaccgacccagttagccgccagcaactcccacaccgagacgtcaaaggtatagggggttttttgcagcacgttatccgccgcctttaaggcatattgggattgcatccagcacaggcggttcatgacgctttggtgcgtcagcatgacccctttgggctggccggttgtccctgaggtgtagatgatgtacgccagatccgtggctccgtttaccggcaccggattgtccattggccggccggcggtcaccgacggatcatccgccgcaatcagtgataacaccggcgtgtattcccccagtgccgtcaggtgccgctgttgggtcaccacgcacggggctgcggtatcggtcagaataaattgggttcgctccggcggatattccggggacaccggcacataggcacccccggctttcagtaccgccagaatactgatgatcatctccagactgcgatcgaggtacagcgccaccggcgtgtctgccggcatcggcacattacgctgctgctgataacgttcgcggatcacggcggccagctggtttgcccgttcattgacctgccggtaagtcagcgtcgcgccggcaaacaccagtgccacgttatccggggtggcgaccacctgagcctcgaattgctgctgcaacgtccggctctgcggatatggcacgtcagtctggttccagcggtgcagcagggtatggcgctcctgtgcggataacacgtcaagcccggccagcgattgcgtctgatcggcgacaaacgccgtcaatacccgctgatagatatccgccatccgcgctattgaggactcgtcaaacagactgaccgcgtaatttataccaccggcaatattggccggctcctcggccataaacaggctcaggtcaaacttggccgggctggatagcaccccgtccagtttcaccgggctgaacggcaggcttgccctgctttgcccgccctcagccaaattctgtaccccgaacataacctgaaaaatggggtggcgggcggtgtcgcgctcaatctccagcgcatcaaccagctgctcaaacggcatgtcctgatgcgccttggcctgagtaatcactgcgtgggtctgtttgatcagcgtttccacgctgccggcgggctccagttgcgccctcaggaccagtgagttaacaaacatcccaatcagcggctgggtttgcgcatggtgccggttgtcggtcggggttcccagcacgatgtcgtgctggccggacagtttcgccagcgtgacataaaatgcactgagcaaaacggtatacagggtggtttcctgcgttttcgccagcgccctcagttgctctgaaagcccgcttcccagcgcgaaattgaaatcctgcccctgataatccacctgtgccggccggcttctgtccgtcggcaaagacagcggctcataaccggccagagcctgctgccagtaagccagctggcgttcccccacctccccctgtaaatagtcacgctgccagcgggcataatccccgtaggtgatctccagtggcggcagcaggctgtcaccgccttcccgcagggcagcgtaaattgccgccagttcatccataaaaacatcgatagaccagccatcaatggcaatatggtgccacaggagcaatagataatgatgttcgtccatccggtagtgacacaggcgcagccccggctcggccgtcagatcgaacggggtggtcagctccgtgcgcaccgcttgcagcagtgcgtcaaacgcctcacaagactgtgaccggagaaccagattaccttccagtacctgctggtaggcctgccccgcctcgtcggtgcggtagaccgtcttcatcaccggatggcgctcaaccacctgatgaatagcggtttccagcagggataagccgtccccatcatggagctgtaccagataagggatatgataggcatgggttccctgctcaaactgttcaataaaccgcatccgctcctgagcaaatgacagcgggtagcgcgccagctcgacgtgggggatcaccgtgcaggcctgctgtcccatctgggcggccagcccggcaacggttttcaactcaaacacctgcgccagaggaatctccactgccaaagcacggcgaatagcggctgtcagcttaatcgcgatcagggagtttcccccgatacgaaagaaattatccttaatgccgacccgctccagtcccaatacatcctgccagatggcacacagccgggtctccagcacatcgcgcggtgccacgtaaccgtcccggctcacccacaccggcgccggcagtgccgggcgatccagcttgccgttcagggtcaggggtaccgtctcaatccgggtaaagctggccggcaccatgtagtccggcaggcgggcggacagatgctccatcagaacttcatccgacagctccccgtccgtgaccacatacgccaccagcgctttgtggccttcatgctcgcggtcaatcaccaccgcctgtttcacctgcgggtgcgaagccagtgcgctttcaatttcccccagttcaatccggtagccacggatcttgacctgaaaatcattgcgcccccgatattccagattgccgtccggccgccagcgtacccagtcaccggttttatacaggcgggtgtaaccccgcacctgatcttccgccgtggcaaacgggttcaccacaaaacgctcagcggtcaacgctggctggttccagtatccgcgagccagccccgcgcccccgatatacagttcccccggcgcaccgatcggggacaggttaccttcactatcaaggacatacagacgggtgttatcaattcccttaccgatcgcccgatccccgtcccgtaacaagtgctgggtggcgcacacagtgatttcggtggggccgtactggttaaacagcgtgacggccggcggtaaactcagtgcattcagcgcttcgccgccggtatggatgacctgcaaggttgaacgggataattcgtcagcaaaatggttcatcaaggcggtgggaataaatgccttgctaatttcgtgcgtattgataaacgacagcaattggtcactgtccgccgtcacggccgccggcgcgataaaaatcgccgagccggccatcagcgccgggaagagttcaaacaccgatgcatcaaacacgtaattggaaaagaataacgcctttaccgtttcccccagtaaatgcgttcgggcaataaaccgggataaattaattacactggcgtgttcaaccatcacccccttcggctggccggtcgttcccgaggtatagatgatgtatgccagatccgcagaggtattcaccggcaccggattatccactgactggcctctggtcacggacggatcatccgccacaatcagtgacagcgcggggctgtattcccccagatctgtcagatgccgctgctgggtcaccacgcaccgggctgcggtgtcggccagaataaattggatccgctctgacgggtaggccggtgagatcggcacataagcaccgccggctttcagcaccgccagcatactgataaccatttccggactgcgatccagatacagcgctatcggcgtatctgccggcatcggcgcatggcactgctgctgatagcgttcacggatcacaaaagccaattggttcgcctgttcattgacctgccggtaggtcagcgctgctccctcaaacaccagcgccacgttatccggtgtggcggccgcacgcgcttcgaactgctgttgcagggtgtggctttgcgggtacggtacgtcggtctggttccagcggtgcagcagggtatggcgctcgtcgtcactgaggaactccactaatcggtgcggctggtgcggatcgcgggtgacggtatgcaggatgcgctcaagctggcacagtaagcgccgcgcctgttcacccgccaaccagtcttcgccataactcaatttcacggtcaggctgtcaccctgttcataggccatcagtaacaccgggtaatccactttttcgatggcctgacggaatgccagtttgttttcaatccctgtcccgtccccgctcatcaccggtgtcgggtagttttcaaaaaccagcaggctgtggaataaacgtgccccgtcgggctgcaaactggcgagtgacaccgcgctgtgactgttgagtgccgcgatatcgttctggattgcgtgtaaaacggccagcacactgccggcaggttcccactgcacggtcaacggcagggtattgatatacagcccgacgctggattcaatcccgtctaccggcacatctcgcccggacaccacggtgccgacaagggtctgctcatccccacagtaactgtgcagtaatttatgccaggcaaattgcagcaccacattcagcgttatcccctgctcccggcacattgtcttgagctggtcataggcatctccctctaccgtcagtctctgcttagccggtttttcaaccgtttttatctgtgtcaggtcaatcccgtgacttaacaacgcagaaagatcattcgccccctgaaaccgggttttgcgttcagcccaatacgcctcagagatatccttgtggttcagatgatattgctgagtcgtcagataggccgtgtccacctcttccggggggcgccgtccctgtaccagcgcattgtaatactcatgcacggtctgcaataaaatcggattactccagccgtcggcaatacagtgatgctgagtgatcagtaccgtcacctgctgtgcctgctgcctgattaaggtgaagcggattaacccgggctggcttaagtcaaaaggcagggttcggtcattttgctggagtgcttcaatcacccggtcccactcttctgccggtaatgaacggatatctttgatcgtgaaattggccggcccgatactggcacccgccgtcacaatctgcaacacctctccttcccagtcaaaggccgtcctgaggacagggaaacgcagtgaagccagtgtccaggcctgctggtaagccgcaaaatccagcctgtcgtgataatccagcagcaactgcacccggtaggcatcatcctgcggctgagccagatgatgataaacaaaaccctgctgcaaactggtggcaggaaatatcgcttcaacctgatatctctgctgaaaacggcttaaccgctcgactgaaacgccttgaatgccataatcactggaggtttttattccccccaagcgggcctgtttttggccggccgtgataaccgtggtgagagcctgctcaaatgccgtgataaatacctgagtctgggtctgtggcaaacgcgataacacattgaattgcaggctacctgcctgaaccgcgccattgatatccagcaacaaggggctggggttattgctggccaccacggcaccacaatcatcgtcagtcagtgaccagtcctgatgacggctctgccctgcgtctccccccagctggccgagatagttgaaacttatcgccggcaactcaccggctaaatccccggcctgatgcaaggctccgtaccctatccctttattcggtaccgccctgagcatctctttggtgtgaataatggtttccgtcacttccggctgcatttccagacgcacgggatacaccgtggtaaaccacccaacagtttctgaaacatcgagcgtgttatcgatgggttcccggccatgtccttccagaatgatgtgatttaccgggcgtgaaaaactggccgacaaggccagagtgagcgcactcaggagtaagtcgtttatctccgtgtgataaccggaattggcctcccgtaacagggtatcagtcagtccggcagagagtgccagccggtgctgactggcttcaccggctgccggttccgtctctttgccggccatcacccgctgccagtaaggtatttcctgttgatgaagcgccgcatagtgatgcaccgcagccacccactggcggtagctgctggtcttcggtggcagggttgcaccttgcagtaataaacgcatatcttccgcaataatacgccaggacaccgcgtcaataatcaggtggtgaaaggcgaagaataaccgggcgctgccgtcagcgtatccggtcagatgaccggcctgccataaagacccggcagcataatcaaacccgccctgccactgcgttaactgttgatgtaatgccgccttctccagctcgctgatctcagcgcggtgtaatgcgggcagcccggatggcatctcagcctgataacattggcggtaaccgtcttgcgtacagacaaagcgggtgcgcagcatatcgtgccgcccggccagccggttcagggcctgctcaatatcagcgtgccggatttctccgggaagctgcatcataaatgcctgattccaatggtgcggacacggcaagttccggtcgaagaacgcctgctggatcggcaataagccaaactccccgcttaataatcccggctcggcaatgattccggccgtcgcggatacctgggtcagcaacttcgccagccgtgccaccgtcggggcatcaaaaatcgatttgacctgtaacgaaaatcccgcctgccggagcttagacaccagccggatactgacaatcgaatctcccccgatacggaagaagttatcctcaatgccgacctgctccagtcccaatacatcctgccagacggcacacagccgggtttccagcgcatcgcgcggtgccacgtaaccgtcccggctcacccacaccggcgccggcaacgcccggcgatccagcttgccgttcagggtcaggggtatcgtctcaatccgggtaaagctggccggcaccatgtagtccggcaggcgggcggacagatgttccatcagggtgtcatccgacggctccccgtccgtgaccagatacgcggccagcactttatggctttcatgctcgtggtcaatcaccaccgcctgtttcacctgcgggtgcgaagccagtgcgctttcgatttcccccagctcgatacggtagccacggatcttgacctgaaaatcattgcgcccccgatattccagattaccgtccggccgccagcgtacccagtcaccggttttatacaggcgggtgtaaccccgcgcctgatcttccgccgtggcaaacgggttcaccacaaaacgctcggcggtcaacgctggccggttccagtatccgcgagccagccccgcgcccccgatatacagttcccccggcgcaccgatcggggacaggttaccctcactatcaaggacatacagacgggtgttatcaattcccttaccgatcgcccgatccccgtcccgtaacaagtgctgggtggcacacacagtgatttcggtggggccgtactggttaaacagcgtgacgtccggcggtaaactcagcgcattcaactcctcgccaccggtatggatgacctgcaaggttgaacgggataattcgtcggcaaaatgattcatcaaggcggtgggaataaatgccttgctaatttcgtgcgtattgataaacgacagcaattggtcactgtccgccgtcacggccgccggcgcgataaaaatcgccgagccggccatcagcgccgggaagagttcaaacaccgatgcatcaaacacgtaattggaaaagaataacgcctttaccgtttcccccagtaaatgcgttcgggcaataaaccgggataaattaattacactggcgtgttcaaccatcacccccttcggctggccggtcgttcccgaggtatagatgatgtatgccagatccgcagaggtattcaccggcaccggattatccactgactggcctctggtcacggacggatcatccgccacaatcagtgacagcgcggggctgtattcccccagatctgtcagatgccgctgctgagtcaccacgcaccgggctgcggtgtcggtcagaataaattgggttcgctccggcgggtaggccggtgagactggcacataagcaccgccggctttcagcaccgccagcatactgataaccatttccagactgcgatccagatacagcgctatcggcatgtctgccggcatcggcgcatggcactgctgctgatagcgttcacggatcacaaaagccaattggttcgcctgttcattgacctgccggtaggtcagcgctgctccctcaaacaccagcgccacgttatccggtgtggcggccgcacgcgcttcgaactgctgttgcagggtgtggctttgcgggtacggtacgtcggtctggttccagcggtgcagcagggtatggcgctcgtcgtcactgaggaacttcactaaccggtgcggctggtgcggatcgcgggtgacggtatgcaggatgcgctcaagctggcacagtaagcgccgcacctgttcacccgccagccagtcttcgccataactcaatttcatggtcaggctgtcaccctgttcataggccatcagtaacaccgggtaatccactttttcgatggcctgacggaatgccagtttgttttcaatccctgtcccgtccccgctcatcaccggtgccgggtagttttcaaaaaccagcaggctgtggaataaacgtgccccgtcgggctgcaaactggcgagtgacaccgcgctgtgactgttgagtgccgcgatatcgttctggattgcgtgtaaaacggccagcacactgccggcaggttcccactgcacggtcaatggcagggtgttgatatacagcccgacgctggattcaatcccgtctaccggcacatctcgcccggacaccacggtgccgacaagggtctgctcatccccacagtaactgtgcagtaatttatgccaggcaaattgcagcaccacattcagcgttatcccctgctcccggcacattgtcttgagctggttataggcgtttccctctaccgtcagtctctgctccgccggtttttcaaccgtttttatctgtgtcaggtcaatcccgtggcttaacagcgcagaaagatcattcgccccctgaaaccgggctttacgctccacccaatacgcctcagaggcctccttgtgatccagatgatactgttgcgttgccagataagccgtatccaccccttccgggggtcgccgtccctgtaccagtgcattgtaatattcatgcacggtctgcaataaaatcggggtactccagccgtcggcaatacagtgatgctgagtgatcagtaccgtcacccgttgtgcctgctgcctgattaaggtgaagcggattaacccgggctggcttaaatcaaaaggctgggtccggtcattttgctggagtgcttcaatcgcccgatcccactcttctgccggtaatgaacggatatctttgatcgtgaaattggccggcccgatactggcacccgccgtcacaatctgcaacacctctccttcccagtcaaaggccgtcctgaggacagggaaacgcagtgaagccagtgtccaggcctgctggtaagccgcaaaatccagcctgtcgtgataatccagcagcaactgcacccgataggcatcatcctgcggctgagccagatgatggtaaacaaaaccctgctgcaaactggtggcaggaaatatcgcttcaattttatttccaggatattggctgggatcaacaaaatttatatcaaaattagactgatctttattaaaaataaaaccttgaaaatcctcttcagaaaaaatacctctttcatttaagaaatctattacgctttgctttttctcttttactttatcaattaattgaacagggggtgtttctcctgtaaacgccagttttaacttattttcacagacccatactgacatgcggtttttatttagttctttcagtaatatcaacatattgttacacatccaaaattgttttcttttccaaatggatagacacattttcgttattcacatgatcaagacgatgagtcagttgatttaactgctcgattgaaacgccttgaatgccataatcactgggggtttttactccccccaagtgggcctgtttttggccggctgtgataaccgtggtgagagcctgctcgagtgccgtgataaatacctgagtctgggtctgtgacaaacgggagctcacactgaattgcaggctgcctgactgaattgccccattgatatccagcaacaaaggactggagttatcgctggctatcatcgccccacaatcatcgtcagtcagtgaccagtcctgatgacggctctgccctgcgtctccccccagctggccgagatagttaaaacttatcgccggcaactcaccggctaaatccccggcctgatgcaaggctccgtaccctatccctttattcggtaccgccctgagcatctctttggtgtgaataatggtttccgtcacttccggctgcatttccagacgcacgggatacaccgtggtaaaccaccctacagtttctgaaacatccagcgtgttatcgatgggttcccggccatgcccttccagaatgatgtgatttaccgggcgtgaaaaactggccgacaaggccagagtgagcgcactcaggagtaagtcgtttatctccgtgtgataaccggaattggcctcccgtaacagggtatcagtcagtccggcagagagtgccagccggtgctggctggcttcgccggctgccggctccgtctctttgccggccatcacccgctgccagtaaggtatttcctgttgatgaagcgccgcatagtgatgcaccgcagccacccactggcggtagctgctggtcttcggtggcagggttgcaccctgcagtaataaacgcatatcttccgcaataatacgccaggacaccgcgtcaataatcaggtggtgaaaggcgaagaataaccgggcgctgccgtcagcgtatccggtcagatgaccggcctgccataaagatccggcagcataatcaaacccgccctgccactgcgtcagctgttgatgtaatgccgctttctccagcacgctgacatcaacgtggtgtaatgcgggcagcccggatggcatctcagcctgataacattggcggtaaccgtcttgtgtacagacaaaacgggtgcgcagcatatcgtgccgcccggccagccggttcagcgcctgctcaatatcagcgtgccggatttcgccgggaagctgcatcataaatgcctgattccaatggtgcggacacggcaagttccggtcgaagaacgcctgctggatcggcaataagccaaactccccgcttaataatcccggctcggcaatgattccggccgtcgcggatacctgggtcagcaacttcgccaaccgtgccaccgtcggggcatcaaaaatcgatttgacctgtaacgaaaatcccgcacgccggagcttagacaccagccggatactgacaatcgaatcccccccgatacggaagaagttatcctcaatgccgacctgctccagtcccaatacatcctgccagacggcacacagccgggtttccagcgcatcgcgcggtgccacgtaaccatcccggctcacccacaccggcgtcggcagtgccgggcgatccagcttgccgttcagggtcaggggtaccgtctcaatccgggtaaagctggccggtaccatatagtccggcaggcgggcggacagatgctccatcagaacttcatccgacagcaccccatccgtgaccacatacgccgccagcgctttgtggccttcatgttcgtggtcaatcaccaccgcctgtttcacctgcggatgcgcggccagtgcgctttcgatttcccccagctcgatacggtaaccacggatcttgacctgaaaatcattgcgcccccgatattccagattgccgtccggccgccagcgtacccagtcaccggttttatacaggcgggtgtaaccccgcacctgatcttccgccgtggcaaacgggttcaccacaaaacgctcggcggtcaacgctggccggttccagtatccgcgagccagccccgcgcccccgatatacagttcccccggcgcaccgatcggggacaggttaccctcactatcaaggacatacagacgggtgttatcaattcctttgccgattgcccgatccccgtcccgtaacaagtgctgggtggcacacacagtgatttcggtggggccgtactggttaaacagcgtgacgtccggcggtaaactcagcgcattcagcgcttcgccgccggtatggatgacctgcaaggttgaacgggataattcgtcggcaaaatggttcatcaaggcggtgggaataaatgccttgctaatttcgtgcgtattgataaacgacagcaattggtcactgtccgccatcacggccgccggtgcgataaaaatcgccgagccggccatcagcgccggaaagagttcaaacaccgatgcatcaaacacgtaattggaaaagaataacgcctttaccgtttcccccagtaaatgcgttcgggcaataaaccgggataaattaattacactggcgtgttcaaccatcacccccttcggctggccggtcgttcccgaggtatagatgatgtatgccagatccgcagaggtattcaccggcaccggattatccactggctggcctctggtcacggacggatcatccgccgcaatcagtgacagcgcggggctgtattcccccagatctgtcagatgccgctgctgggtcaccacgcacggggctgcggtgtcggtcagaataaattgggttcgctccggcgggtaggccggcgagatcggcacataagcaccaccggctttcagcaccgccagcatactgataaccatttccggactgcgatccagatacagcgctatcggcgtgtctgccggcatcggcgcatggcgctgctgctgatagcgttcgcggatcacaactgccagctggttcgcctgttcattgacctgccggtaggtcagcgctgctccttcaaacaccagcgccacgttatccggtgtggcggccgcacgcgcttcgaactgctgttgcagggttttgtcctgcgggtacggcacgtcggtctggttccagcggtgcagcagggtatggcgttcctgcgcggataacacgtcaagcccggccagcgattgcgtctgatcggcgacaaacgccgtcaatacccgctgatagatatcggccattcgcgctatcgtagactcgtcaaacaggctcactgcgtaatttatgccaccggcaatactgcctgcaccttctgccataaacaggctcaggtcaaacttggcggggctgtgcaaagcgccctccagtattaccggactaaacggcagacctgccctgtttggctgatcctcgccaagactctgcaacccaaacataatctggaaaatagggtgacgggaggtatcgcgctcaattgccagcgcatcaaccaactgctcaaacggcatgtcctgatgcgccttggcctgagcaatcactgcgtgggtctgtgtaatcagcgtttccacgctgccggctggctccagttgcgccctcaggaccagtgagttaacaaacatcccaatcaatggctgggtttgcgcatggtgccggttgtcggtcggggttcccagcacaatatcgttctgtccggtcagtttggccagcgtgacataaaacgcactgagcagtacggtatacagggtggtttcctgcgtttttgccagcgcccttaactgatgcgaaagttcgctctccagcgcgaaattgaaatcctgcccctgataatccacctgtgtcggccggcttctgtccgtcggcaaagacagcggctcataaccggccagagtctgctgccagtaagccagctgacgctcacggatctcaccctgcaaatagtcacgctgccatctggcatagtccccataggtgatatccaaagccggtagttggctgtcgcgggatgccagcagagcagggtaaatctccgccagttcatccataaaaatattaatggaccagccatcaatggcaatatggtgccacatcatcaataagtaatgatgttcagccacccgatagtgacacaggcgcaggctcggttcggtcgtcagatcgaacggggtggccagttcagcacgtaccgtttgcagaagcgcgtcaaacgcctcacaagactgtgaccggaaaatcaggctgccctcaagcacctgctggtaggtattcccctcatcgtcagtgcggtagaccgtcttcatcaccggatggcgctcaaccacccgattaatggcggtttccagcaggagcaggttcgcttcgtcatccagttgcaccagataaggaacatgatagacactgctcccctgctcaaactgttcgataaaccgcatccgctcctgagcaagcgacagggggtagcgcgtcagctcgacatgggggatcaccgtgcaggcctgctgccccatctgtgaagtcaatccggcaatagttttcaactcaaacacctgtactaatggaatctccaccgccaaaacacggcgaatggcggctgtcagcttaatggctatcagggagttgccaccaatacggaagaaattatccttaatgccaacccgctccagccccaatacgtcctgccagacggcacacagccgggtttccagcgcattgcgcggcgccacgtaaccgtcccggctcacccacaccggcgccggcagtgcccggcgatccagcttgccgttcagggtcaggggtaccgtctcaatccgggtaaaactggccggcaccatgtagtccggcaggcgggcggacagatgttccatcagggtgtcatccgacagcaccccgtccgtgaccagatacgcggccagcactttatggctttcatgctcgtggtcaatcaccaccgcctgtttcacctgcgggtgcgaagccagtgcgctttcgatttcccccagctcgatacggtagccacggatcttgacctgaaaatcattgcgtccccgatattccagattgccgtccggccgccagcgtacccagtcaccggttttatacaggcgggtgtaaccgcgtgcctgatcttcggccgtggcaaacgggttcaccacaaaacgctcggcggtcaacgctggccggttcaaatacccacgtgccagccccgcgcccccgatatacagttcccccggcgcgccgatcggggacaggttaccctcactatcaaggacatacagacgggtgttatcaattcccttgccgattgcccgatccccgtcccgtaacaagtgctgggtggcgcacacagtgatttcggtggggccgtactggttaaacagcgtgacgtccggcggtaaactcagcgcattcagcgcttcgccgccggtatggatgacctgcaaggttgaacgggataattcgtcggcaaaatggttcatcaaggcggtgggaataaatgccttgctaatttcgtgcgtattgataaacgacagcaattggtcactgtccgccgtcacggccgccggcgcgataaaaatcgccgagccggccatcagcgccgggaagagttcaaacaccgatgcatcaaacacgtaattggaaaagaataacgcctttaccgtttcccccagtaaatgcgttcgggcaataaaccgggataaattaatcacactggcgtgttcaaccatcacccctttcggctggccggtcgttcccgaggtatagatgatgtatgccagatccgcagaggtattcaccggcaccggattatccactggctggcctctggtcacggacggatcatccgccacaatcagtgacagcgcggggctgtattcccccagatctgtcaaatgccgctgctgggtcaccacgcacggggctgcggtgtcggtcagaataaattgggttcgctctgacgggtaggccggtgagactggcacataagcaccgccggctttcagcaccgccagcatactgataaccatttccggactgcgatccagatacagcgctatcggtgtgtctgccggcatcggcgcatggcactgctgctgatagcgttcacggatcacaaaagccaactggttcgcccgttcattgacctgccggtaggtcagcgctactccctcgaataccagcgccacgttatccggtgtggcggccgctcgcgcctcgaactgctgttgcagggtgtggctttgcgggtacggtacgtcggtctggttccagcggtgcagcagggtatggcgttcctgtgcggacaacacatcaatcccggccagcgattgcgtctgatcggcaacaaacgccgccagcacccgttgatagatatccgtcatccgtactatcgtagattcattaaacaggctcaccgcgtaatttataccgccggcaatactggactgctcttccgacataaacaggctcaggtcaaacttggcggggctgtgtagaactctatccagtctcaccggattaaacggcagacctgccctgtctggcaggctctcacccaaattctgcaccccaaacatgatctggaaaataggatgacgggcggtgtcgcgctcaattgccagcgcatcaaccaactgctcaaacggcatgtcctgatgcgccttggcctgagcaatcactgcgtgggtctgtttgatcagcgtttccacgctgccggttggctccagttgcgccctcaagaccagtgagttgacaaacatcccaatcaatggctgggtttgtgcatggtgccggctgtcggtcggcgttcccagcacgatgtcgttctgtccggtcagtttggccagcgtgacataaaacgcactgagcagaacggtatacagggtggtttcctgcgtttttgccagagaccttaactgatgagaaagcgtattccccagcgcaaaattgaaattccgtccctgataatccacctgtgccggccggcttctgtccgtcggcaaagacagcggctcataaccggccagagcttgctgccagtaggccagctgacgctcacggatctcaccctgcaaatagtcacgctgccatttggcatagtccccataggtaatatccaaggccggcaattggctgtcgcgggatgccagcagagcacagtaaatctccgccagctcatccataaaaatatcaatggaccagccatcaatggcaatatggtgccacatcatcaataagtaatgatgttcggccacccgatagtgacacaggcgcaggctcggttcggtcgtcagatcgaacggggtggccagctccgtgcgcaccgcttgcaggagcgcgttaaactcctcacaagactgtgaccggaaaatcaggctgccctcaagcacctgctggtagacctgccccgcatcgtcagtgcggtagaccgccttcatcaccggatgacgctcgactacccgattaatggcggtttccagcaggggtaaacagtcgccatcatccagctgcaccagataggggacatgataaacactgctcccctgctcaaactgttcgataaacagaatccgttcctgcacaggcgacaggggataacgcgccagttcaaggtgagggatcaccgtacaggcctgctgccccatctgtgcggccagaccggcaacggttttcagttcaaatacctgtatcagcgggacttctactgccagagcataacgaatagccgccgtcagcttaatggccatcagggagttaccgccgatccggaagaagttatcctcaatgccgacccgctccagccccagaacatcctgccagacagcacacagccgggtttccagcgcattgcgcggcgccacataaccgtcccggctcacccacaccggtgccggtaacgcccggcgatccagcttgccattcagggtcaggggcaccgactctatccgggtaaaactggccggtaccatgtagtccggcaggcgggcagacatgtaccctatcagtagctcatccgacagtatcccctccgtgatcaggtacgccgccagcgctttatttccctcatgctcgcggtcaatcaccaccgcctgtttcacctgcggatgcgcggccagcacactttcaacttctcccagctcaatgcggtagccgcggatcttgacctgaaaatcattgcgcccccgatattccagattaccgtccgcccgccagcgcaccagatcgccggttttatacaggcgggtgtagccccgcgcctgatcttccgccgtggcaaacgggttcgccacaaaatactctgccgtcagttccggccggttccagtacccgcgggccactcccgcgcccccgatgtaaagctcacccggcgccccgacgggggacaggttgcccccaccttcacgtacatacaggcgggtgttatcaatcgcccggccgatcggcacattgccattaaattcaccggcagtatcaaaataggtgacttcaatcgccgcttccgttggcccgtaaaggttaattaaggcactggcacccggattaatcgtcttaaacgccctgacctgtgatccggtcagcgcctccccgctacagaaaacataacggacagtggccgccaaccgctgatttaaggcctgtaacgactggcagaaagcactgagcattggcgggataaagtgaaccaccgttaccccggtttcctgcatcagtttatgcagggtttccggctgtctgtggctgtcaggcggggcaatcacaatacgggcaccaacccagttagccgccagcaactcccacaccgagacgtcaaaggtatagggggttttttgcagcacgttatccgccgcctttaaggcatattgggattgcatccagcacaggcggttcatgacgctttggtgcgtcagcatgacccctttgggctggccggttgtccctgaggtgtagatgatgtacgccagatccgtggctccgtttaccggcaccggattgtccattggccggccggcggtcaccgacggatcatccgccgcaatcagtgataacaccggcgtgtattcccccagcgccgtcaggtgccgctgttgggtcaccacgcacggggctgcggtatcggtcagaataaattgggttcgctccggcggatattccggggacaccggcacataggcgcccccggctttcagtaccgccagaatactgatgatcatctccagactgcgatcgaggtacagcgccaccggcgtgtctgccggcatcggcacattacgctgctgctgataacgttcgcggatcacggcggccagctggtttgcccgttcattgacctgccggtaagtcagcgttgcgccggcaaacaccagtgccacgttatccggtgtggcaaccacctgagcctcgaattgctgctgcaacgtccggctctgcggatatggcacgtcagtctggttccagcggtgcagcagggtatggcgctcctgcgcggacaacacgtcaagcccggccagcgattgcgtctgatcggcgacaaacgccgttaatacccgctgatagatatctgccatccgcgctattgaggactcgtcaaacagactgaccgcgtaatttataccaccggcaatattggccggctcctcggccataaacaggctcaggtcaaacttggccgggctggatagcaccccgtccagtttcaccgggctgaacggcaggcttgccctgctttgcccgccctcagccaaattctgtaccccgaacataacctgaaaaatggggtggcgggcggtgtcgcgctcaatctccagcgcatcaaccagctgctcaaacggcatgtcctgatgcgccttggcctgagtaatcactgcgtgggtctgtttgatcagcgtttccacgctgccggcgggctccagttgcgccctcaggaccagtgagttaacaaacatcccaatcagcggctgggtttgcgcatggtgccggttgtcggtcggggttcccagcacgatgtcgtgctggccggacagtttcgccagcgtgacataaaatgcactgagcagaacggtatacagggtggtttcctgcgttttcgccagcgccctcagttgctctgaaagcccgcttcccagcgcgaaattgaaatcctgcccctgataatccacctgtgccggccggctccggtccgtcggcaaagacagcggctcataaccggccagagcctgctgccagtaagccagctggcgttcccccacctccccctgtaaatagtcatgctgccagcgggcataatccccgtaggtgatctccagtggcggcagcaggctgtcaccgccttcccgcagggcagcgtaaattgccgccagttcatccataaaaacatcgatagaccagccatcaatggcaatatggtgccacaggagcaatagataatgatgttcgtccatccggtagtgacacaggcgcagccccggctcggccgtcagatcgaacggggtggtcagctccgtgcgcaccgcttgcagcagtgcgtcaaacgcctcacaagactgtgaccggagaaccagattaccttccagtacctgctggtaggcctgccccacctcgtcggtgcggtagaccgtcttcatcaccggatggcgctcaaccacccggtgaatagcggtttccagcagggataagccgtccccatcatggagctgtaccagataagggatatgataggcatgggttccctgctcaaactgttcaataaaccgcatccgctcctgagcaaatgacagcgggtagcgcgccagctcgacgtgggggatcaccgtgcaggcctgctgtcccatctgggcggccagcccggcaacggttttcaagctaaacacctgtgccagcgagacttccactgccaaagcacggcgaatagcggctgtcagcttaatcgcgatcagggagtctcccccgatccggaaaaagttatcctcaatgccgacccgctccagtcccaatacatcctgccagataacacacagccgggtttccagcgcattacgcggtgccacataaccgtcccggtttccccacatcggcatcggcagtgcccggcgatccagcttgccgttcagggtcaggggcaccgtctcaatccgggtaaagctggctggcaccatatagtccggcaggcgggcggacacgtactccatcagaacttcatccgacagctccccgtccgtgaccacatacgccaccagcgctttgtggccttcatgctcgcggtcaatcaccaccgcctgtttcacctgcgggtgcgaagccagtgcgctttcaatttcccccagctcaatccggtagccacggatcttgacctgaaaatcattgcgcccccgatattccagattaccgtccggccgccagcgtacccagtcaccggttttatacaggcgggtgtaaccccgcgcctgatcttccgccgtggcaaacgggttcaccacaaaacgctcggcggtcaacgctggccggttcaaatacccacgtgccagccccgcgcccccgatatacagctctcctggggcaccgatagggacgagatgacctgagtcattcaaaacataggcatgcatgtcatttaacggtcgtccaatgcaggatgccgttataacgtcgtcttttattaatttctgataggtaacatgtaccgttgtttctgttatcccatacatattgacaagagttggtgattgatccccataactatcccaccagggcttcaactgaacaggattaagtttatctcctccaaagatcacataccgaagacaggggaatttagcgccaatactcaacgaggcatcaataaaagcataaaatgcgcctggagtttgattcaggacggtgactttttggtgtgagcacaagcggctaaagctgacaaaatctttcgtgcaatcgacggttggaataattaaacgcccaccatatattaatgctccccataattcccagacactgaaatcaaaggtataggcatgaaaaagaacccaagtatcattttgatcaaattgataatccccttgggtgatagcaaataaacgcacagcattatgatgagtctgtaataccccttttggctgcccagtcgttcctgatgtgtaaatgacatatgccagatcagcggctccgttcaccggcaccggattatccactgaccggccgtccgtcaccgccttgtcatctgccgctatcagtgccggctggtcaatcagaacttttgtgcattcactcagtgtcgtcaggtgtctctgctgagtcaccacacacggagattgggtatcttccaaaataaactgaatccgttccggcggatgttcagggggcatcggcacataagcgcccccggctttcagtactgccagaatactgatgaccatctccagactgcgatccaagtacagtgccaccagcgtatctgccggcatcgcttgattgtgtcgttgctgatagtgctcgcggatcataaaggccagttggttcgcccgctcattcagctggcggtaagtcagcgtttctccttcaaacaccagtgctacattatctggcatggcagccgcacgggcttcgaattgttgttgcagggtttgattttgcggatacagcgcatcggtctggtgccaagtgtgcagtaaagtgtgacgttcctgttctaataaaataggcaattcattaactaataaagaaggttttttaatcaacgcagcaaataaatttttcaaacgttcaaatattttccctacatcctgatcactaaaatacgcctgcaaataatttatatttatttttagttcctgatcagtgccgccataatccttgaatcgaaaaacaataggataaatattagcggttccttctatatgattatatttattttgagttatttcagatgctgactctgaaaatcgatcgtagaaaataaataaattaggtaaaggaatcccaaagttattggcgattcgaataaggtgagaatggggaaatttacagtggcgataactatttttgtacgataagtctattaatttaatctgttcaatcacacttagagagtgcgaaacctggcaatgcactgggtaaatatttgcatgcattccaatgacatgcttatctaatcttctttttcttccgtgtgtgatagtactaaatgtcaattcttgttgccccgtaagttctgccatcatgatgatgactagactcgaaaagacagcaaaaacattagtattattttctctacaaaaaatacgtaaatctgatgtcatctcagaaggtaatgttagcgaaccaacaccactacccgtattttgatagcaaggcgttaaagggtatatttcatgttcttttaaaaaatcacaccagtagtgtttatccgtttcgtaatgagaagaattcagatatttccttgctttagttattgtatctaaatattgcggaatttctaacaaccaagctgttgatgttccatttttaatacatccgtacaatttattaacatactcatggagtcgaaataaccctacaccatcaatcataatatgatgaaatatagtgaaaaaataatatttttcctctgtcatacgaatcaatgaaatctgatatggagtttcctgtaaaaaatttataggattatctatttgctgctgcatccaaagttgtgcttttttttcaggatcaggctgcattgcagcatcataaaatataatttcttcaggtacaccttgatcttggatatattgtatagcttcattgtccgaattaaccgatatgcgtaatcgtaacatatcaatatgttgatgtagtaaattccacacttgctgaaaagttactatatcaacattttcctctatcaatgtataccaacctaggttgtgtaatgggttattttcatagagtgcctgctcgtaaaacacatcctcttgagcgggatgaaggttatataagttcgagttcaacgagctttcagatgttctcataataaattatacgaatgcattccgttcgcaagttacttttactctgtgacacaaacgagtagatttcagctctacacttcaccttcagcaattaatttttgggtattaatgtaatccactgtcccacacctaactcttttacctgtttttatcccataccatgatgtgaatttaatgggtttcggcattatttatcgttgtatcactatagcgattctcgcaatctttcagcattctcctttatacaaaaatagttaatatctatcagccttagtggttaaaagcacccattactgatgtgacttccttcatatatttagtctaatactctttctacctaagttattacgttcaatttattcatccttttaatcccaattattatttattactctttatttattaatatagctcacgataactacaatttcttttaactgtaatattgattgttattttgattgaagtctatattattttttatttaatataggtgcgttttttaattattttaaaataacaaaacgaaacaataactattatttaaaaataacacattataacttaactcattattatagtattttactggtataataaatgatatatttctattattaacttccttactggtttgaattattttcgttacagataattgataacttgattaatttatccgagtaattttatctctttgacagaaaataaattataaggaaatgaaccctgaaatagatgtttacataaaaatggagtggtaataaataaaactattttgtacggaattgaatccagaataaatctggctctgcggctgtaacgtgccatcaaactcgaaaaggtatatctgaataggggctatgcccctattttttataattcgttaagaatgataacccgaattacgcgggtctaattccttatgccagagcagcaaatcatcacggactttctctggtaatacggcaacatggcaaccttctatcgcaccagccaacgcaagcaatatgctgacattcgtctgttttctgtgttgctgtaatttaaggtaagccgcttttgctcccagcatatgcaactcttctactttagatatgccgactttccatagttggcgttctaaagtcattcccaagttagggagatcttttaacctaaggggcattttttgcttatcgataatttctgccattgtatattgataagctaagttgacatattcaaacaactgcttttgatcctgccaaagtgactcattaacccggtagtatcgtaaagtcacaggaatgcccctttttgaaaaaataaatttctccatgcctctggctttaaataatacctcagcatgactatttcctcgtaaataaagttcaccatctgaactaatggcaaataaaaccccatcaagtaacaacccaaacccaccaaattgagattttttcttaagttttcccaatgaagatacgccgtgtttcaattgagcaaaacgcgccccagataaaaacatttttatcactccatgaattatatctcaattaatatctttccctgttgctattaacaaaatagataacaagaacaagtaattaaaaccatacgcaatctgtttccaactgccaatcgttaagtcagaaaaaaacggttttatgtaaatttttgcgaagcgctttgaaaaaaaataggcttgcttttaagtaaatagcgatatactgtataaatatacagttcattgtgacgagaaacattatgggcattcgatcatcttggggatatctgattgagaagaaaacggcagtgaacggaacggagaaagaacaaaaaacagacaattatccggttttcaaaatagacaaaatgacaagtctcaaaactgccagtcggctatcttttgtcgaatcatcccaatctgattcacaagtagtaaaaggaatggtcagtgaactgatctactgtgagcaccagccagctatcaatcaccttctgcttcctttactccgtcaatccgggcatgaaaatcgctggttactctgggttacacccaataaaagattgagtcgtcagtggctgatgagttctggtttacctttagataaagtcgttcaattaaatcaaatccgtcctgttgcatcaattgatgccatggaaaaggctctggcgagtggcaactacagtgtagttctgggctggctaccagagctatctgagtatgacgtgcaaaagctacaactggccgcccagaaaggtacggcgttgggatttattatgcgcccacaaaactcggctcatcatttcaaaccaccagtaaacaggttacaaatctattctgtttactatcattgactggaattgagatttatcccaatttcttttataaaaaataagctactactgctacctatccttgttttcaatggaaatcaatatattaatgctgtcaatattgtaaatgttcgtcaaaaacattcataatttgtatggatgaaactaaaaattttgtgccacgagtcacagtgtacttgtaagtttttaagttcgttgtagactttactcagtttagatttgtactagccgcccttatatttttcaggacgcatctagtgatagaagtacaaatacttaactagacattttaaccaatggctaataataaggcttttaaggccaattgcctatttggatgataacgaggcgtaaaatgaaaaagacagctatcgcagtagcagtggcagtggcagctttcgcaactgttgctcaagcagctccaaaggataacacctggtataccggtgctaagctgggttggtctcagtaccatgacgtgaatttttacggcaatggatatgataaccaaatcggtaacggccctactcgcaaaaaccagctgggtgcaggtgcctatgttggttatcaggcaaacccatatctaggatttgaattgggttatgactggctgggtcgcatggcatataaaggcagcgtcaacaacggtgctttccgtgctcaaggcgttcaactggcggccaaactgagctacccagttatggataatctggatgtctatactcgcctgggtggtatggtatggcgcgcagactcttccgctacttataatgctaacgcattaggtggtgcaggtgataaagatcagcgcagactgaaaaacaacgacacaggtgtttctccactggctgccattggtgttgaatacgctctgacgaaagatctggcaacccgtctggattaccagtgggtcaacaacatcggcgatgcaggcagtgtcggtgcccgtccagataacggtatgctgagcgttggcgtttcttatcgttttggtcaagatgacgtggctcctgtcgttgtacctgttgctccggttattccaacgcctgcgcctactgttgaaaacaagagctttactctgcgctctgacgttctgttcaatttcaacaaatcaacgttgaaaacagaaggtaaacaagagctggacaacctttacacccaactggccaaaattgacccaaatcaaggcagagttctggtaatcggccacactgatcgtatcggtagccagcagtacaacttgccattgtcccagaaacgtgctgaatccgttgttgattatctggtagctaaaggcatcccggcagccagcatccaagcagaaggccgtggtaaagaaggttctgtcactggctctacatgcgataacatcaaaggtcgcgctaaactcattgactgtctggctccagaccgccgtgtagttatcaatattcagggtactaaagagatcgttactcagccaaaagcggcacagtaatagtcacactgccctccatatttaattaaaaaccccatgttaacatggggttttattgtttctgtctatagctcttatttccccaaaatagcttccaaatcctgctttagactcgacatttgatgggtatatttttctctatattctgcatcttccagcaattgcactatcgtttctgataaggtattgccacgacgtcgggaaagagcagaaagccgctgccaaacccggaaatccaaatcgatggatttttttcgcgaatgttgatgttccgcattaaaatgacgtttacgccgcgcccgaatcgtctgtttcatccggttggataaatctgggttcatatgccgcgaaatccatttcagtaccttaattggctcacgctctaactgcatcaactcaatgatcgcatcctgcgctgcgctcttttcaatgtatttagtaattagctcaccttcacgatattttttcgctaaataagcccatttccagccacattccagattttccaattgctgatatttcattttatctctcagtgacagcgtaacttaaattaagcatagcaattatttcccttaattgctcacagcaacacagtatattagaatattttatagataattaatgagttaactcaaatgtcatacctttcaaagattatgacatgtcggttcattgcctaatcttgtataataaacgtttcccttttcactatatgtagctatcactttgacgaatataaaattagactggcaggcattacagctaaacagtacgccttatcaagcactcttcaattctgtcgctgaattagcacccgtcactatggatgcaattcaatccaggttacacaatgggttaaccctcttttgtcaggccgatctgcgtcagccttttatgttagtaaaggcggatgagagtgatatttatctgtctcatttatctgatactatctcagctttactgccggaaagtcgtccaaaaatcggtggttactatcagatagaacaccaaaccattacttggcgttcttctggtgaaggctcctttgcaccaactgaacgggttgcttatcgcgaatggattgaaccggagcaattattcggcaacatctacacccatcaaggtgcacttcagctacaacctggccttatccatcaggtcaatggcggtgtcctgattttgcctttacgtaccctactttctcagccattaatgtgggttcgtcttaagcagatgattatccagcgccgttttgattggctatcacacaatgagaatcactcactgcccctgcctgtaccttcaatgccgttgaatttgcagctcgttctggtgggagatcgcctgagtattgaggaactacacgctcttgagccagaattggccaacaatgctctgtatggcgaatttgagttggatatgccatttcatgaagaagatgatctagcgctatggtgccgctatgttaacagaataattcagcagcaaacattgcctccattaagcgctgatgcatggcctgtactgctcaaacaagccattcgttataccgaagaccaactcagcttacctttggatattcagtggttacaacaaaaactggaaacagccgccgcttaccaacaggaaaatcaaatcacatcgcattcgatgcaacaagcggaagataatcgtctctggcgtcatggctatttggctgaacgtagcatagacgaaattctgaaaggtcagatactgatccgtacacaaggctcagtaattggtcaaatcaatgggttatccgtgctcgaatatccagggcatccagatccgatgggcgaaccttcccgcatcagttgcgttgctcatttaggagacggtgaatttattgatgtggaacgtaaagtggagctaggcggcaatattcatgcaaaaggcatgatgatcatgcaggcgtacttgatttctgaattaaaactggatcagccacaaccgttttctgcttctattgtgtttgaacaatcttatggcgaagttgatggcgacagcgcctcactggctgaattgtgtgcattaatcagcgctctgtcacaacaacctattgatcagcaaattgccgtaacaggggctgtagaccaatttggctatgttcaatccattggtggcgtcaatgaaaagattgaaggtttcttccgtttgtgtaactaccgggagctgacaggtaagcaaggcgtgattatccctacgtccaatgtgcaacacctgtgtctgaatcaagacattatcgacgcggtaaaaaatgggcaattccatatctggacagttgagcatgtctctgaagcagcatcactcctgacaggtattccctattacgatccacaaaaagaacacttgttagccattatatacgaacgcattacacaggctaatagtcaagagcggcctaaacttccttggtttcttcgctggttaggttaattcagttttatctgatcggagttgttcagcgtacaagtgtacgctatcctctgaccttacataattaaaaggctatccaaaaatatgtttaacaaacaagagtcctatacaaaagaagaacttcaaacctctggacaaggagagttattcggtgaaaatggcccgccactacctgctgacaatatgctgatgatggatcgcatcatcaaaatgacagaaaccggaggtgcctacgataaaggctatgtcgaagctgagttagatattaatcctgagctgtggttcttccgttgccattttgtcaatgatcccgttatgccaggttgcctcggccttgatgctatgtggcagctcgttggcttcttccttggctggatcgggggtgaaggtaaaggccgtgcgcttggggtgggtgaagttaaattcacaggccaagtgttaccaacggcaaaaaaagtcacctatcgcattaattttaagcgaattgttaaccgtaagctcattatggggctagctgatggtgaagttttggtagacggtaaactgatttataccgcaaaagatttgaaggtaggattatttaaggacaccagtgccttttgactatttcgtattggctgcaaacgcttatttccagtgctaatcacctccgctactgcggcggaggtgattatcctaatgaatcgagtattaaccaaacttacttatcgtcaagcacggtcttccatcgcttgacgccagccacccaaccaatgtgaacgcgcatccaatgaatgataagggcaattctcccgcggccgtccgtgaattccagcttgataacctctggaaagtgctcttgccaaacggtctcttttctgtcttttcatgccttacttcctcatcttattaccatgtaaataaaacaatgatcgtttttcatccacatggttctaagtgatacccttatatgcagcgaagatcaagcaaagatgttcatagaaatgtcaaatacaccgtaccaattatacggaagtagctatctgactagcgatggattgagccaactgactataacctgttgccaaagtgcgtactaattcagcataaccatctattttctgttccaactcaagcttgaatggctgcttaatcacgcctccctgattaaataacatccaatatccttgaatcatcacctttccgtcataccgtccgtgaaaagcggttattgtgatatccagagtatccgcatttttctccagcggttgtccggcaatcagtctttgaggaaatgccgcgcttagttcggtgatcaaaacctgctttaattgctgttctaatgggctagcccacaagtgattcgaagcattgacatagatcacgtcccctgtttgataaacgatacccggtgatgcaaggtaatcagcaagagttacgccttttacccataactgtcgttcatctttgacacctgatctactttcctgtgatgtactcgttaaagccggtagctgatagtaagttttttgtggctgactactgctgcaccctgaaataaatacgctactaacagcaaaaacacagacagaaataaaaaacgccaatcttgacatcaactttttcattagttacgcgcctttttgggttcaggatctttcatctcttcagcttcaaataccaatgcgttgcttttattgttaagtgtcttcaaaacaggttgtaattcacgcaagacttgatccaaccgttgcatattatcaatcagcttattgtaagccggagatccgggttgaatgccctgcatactgcggtttaattcttgcagtgtattttgtatatctttgggaagcccctgagtttctttactcgcaaggatgcgatttaattcatccattgttttttgagctgccttgatggttttctggctttcttctaatgtccgggtagcttgaacaaatacgggctcaatcggaatattattaattttatccagtgccataatgactttttgctggatttgagccaacccaccacttactgttggcaaaatttcataacctgcgatttcatatggacctatccatttttcctcattggggtaaaagtccaaatcaatgaataatgcccctgtcagtaagtttcctggcttcaaagaggctctcaggccgcgcgcaataatttcctcaagttccttatcagtataaaaaccactaccaatctctttctcaaaacgctcaggttcaatatgaatcaatacgggaatacgaaagtcattatcaagtcgctgtctaacgccttcagtgtaaaaagacacttttgccacagttcccacccgtataccacgaaattcgactggcgctcccagctgcaagccacgaactgaatcagcgaaaaacaacaacaagtctttatgctttgtatagagtgaattttggatatttttctcactgtcataaagtttgaaagtttctttttctttaaccgggttgcctaaatcccaacctttcggtacatcaaaactgacaccgccgccaaacagagtggataatgatgcaacctcgacccgtaacccctgtgaggacatgtcgaaagcaacaccgctgtctttccagaatctgacacccgtggtcaacaatccatcatagggtgcattgacgaaaatctggtagcgaatcaaccgcgatttgggatcaaaggtactggtttcaaccgaacctacccgatacccccgaaatagcaccggatcaccgggagttagctgccctgctttttcactgattaaaaccagacgcattccttttgcatcaggagacgccagcggaggtgagtccagtaatgaaaatttattctcttcaccgccttgattgcctggctgtaattcaataaataccccggacagtaatgtactcaagccagaaatcccttcacggccaatttgaggtttaacgacccaaaatgcagtatcttggtataatagccgttccatgccatcattcagacgagccttgatgataacttggcctaagttatcactcagtgacacacgttcaactacaccgacatcaacactacggctttttattttggttttgcctgcttcaatgccctccgcattggatgtcatcaatgtcacttcaggcccttgatgactgaaatgataaaacaatatccaggcgccaataagcacagtgataattggcacaatccatacaggtgaccaactcttgagtttactgattctggcctgagtcagatcttcttctttatccgtcaccttacgactcctcatttttctgtaactcaaatttatgattggctttgtcccaagttaagcgcggatcaaatgttattgacgcaaacatcgtcaaaataacaaccagagcaaacaggactgctccggtggcaggatagacgctcatgaactgccccatgcgaaccagcgctgatagcaccgcaataacgaaaacatcaatcatggaccagcgcccgacaaattcgaccatttcatagataaaatgcatcgtttcagaatcatgactgctctgactcttcgcatcccagcacagccaactgatagccagcattttcagtataggcaccataatactggcgatgaaaataaccattgcaaccggataagaacctgtgctccaaagtagaataatgccttccagaatggtggagttaatatggctactcaatgcctgagtcaccataatcggcagcaggtttgctggaatataaagtatggcggatgttatcaatagtgccatagtgtattggaggctatagcgacgacgggcatgccccgtagtaagacagcgggaacactgcggctgctgggctggcaagatggcggtacaacacagacacagcctgacaccttgcaccaaacccggtttacctgcctgtaaaggtatacacacttcaggcgctggctctatttcattccaaaaccagtgtctgtcaagacattgaaatgctctgacctgaaacaggcagaacagacaataaggcaagaaactcaacccaataccaatgtcgccataagccattaacttgacaaagctaactaacactcctgcaaggaagatctctgccatgcaccaggttttcatctgaaacagaatacgcgccagctcaattttcaagcgacgcgccattttaatgttctgacacaagagaataatggcgaccatgcaacatgccggtacgagctgaacaaaaatcaggaaaaacaccgcgatgcttgaatagtcttcgctaaacatcactttcgggatctgaggcagcgatatttcactaacaatacccgcgatattcatgctgacaaacggaaagaggttggcgaggaacagcatcaataatgcactcgctgcatagcctgttggctgattacgtggctctttccactttgctgtcagcaaagtttcacatcgtgggcaagccgctttgttcccttgttccaagttaggcacggccaccagcatgtcacactgaggacacaaaaccagcttgtcatgctgatgattattggaacacaaagtgtttctcctgtagcaaaatcaacaaggccattttcttgatctttcagattgctgctgcgttcactcaccccagccacatagtaatctatgcgtctgggggatttattcacttaccgccacactacaaattgaaatttattggaaataggcagcagtcatcatccattttttatcatttccagttcctgccagcgatcaaaagctttttccagcttctgctctttatttgccaattcattcagaacattttgtgtgattgcgtgtggttgattgaagaattcagaatcaccgacctgggattgcaattgttctatttcttcctctaacgtttctaataatgatggtagttgttctaactctcgcagtaaatggtaacttatcttattgcttgttcgtttagatgtttctttagactttactgctttcgtctcgatactattttttttctctgaagactggtgtaaagagatagtctgcgtccgttgttgttgggcatcgtaataacctcctacatagttattgatttcgccattgccttcaaaaatccagcattcagtcacggaattgtcaacaaattgacgatcatggctaaccaaaattaccgtacctgtatagccatcaaccaattcttcgagtaattccagcgtttcaacgtcaaggtcgttggtcggttcatcaagaatgagtaagttgctcggtttcaggaacaggcgcgccagcaacagtcggttacgttcaccgccagagagagcccgcacaggcgtcatcgctcgcttaggatggaaaaggaagtcctgcaaataacccagtacgtgacgggagcgtccattcaccatcacttcctgcttgccttctgcaaggttatccatgacagttctgtccggatctaatgcggcacgatgctgatcaaagtaggccacttcaagttttgtcccacaatgaatgcgcccactatctgacagcaaatctcccagcatcagtttcaataatgtcgtttttccacaaccatttggcccaaccaaagcaattttatcgccacgctgaacttgcgctgagaaattcttgaccaatgatttatcaccaatctggtaattcacattttccagctcaaacacgattttaccggaacgtgtcgcttcttcgacctgcattttcgccgtacccataacattacggcgatcggaacgctccacgcgcaacgctttcaacgccctgacccgcccttcgttacgggtacgtcgtgctttaatgccctgacggatccaaacttcttcctgagccagctttttatcaaattcggcattttgtaattcttcaacccgcaatgcctcttccttgctttcaaggtatttatcgtaatttcctggccacgaagtcagttttccgcgatctaaatcaatgatgcgcgttgccatactgcgaatgaatgagcggtcatgagaaataaaaacaaggcttccgttgaagtctttcaaaaaattttccaaccactcaatcgtatcaatatcaaggtggtttgttggttcatcaaggaacagaactttaggcgagctgactagcgcccttcccaatgcggccttacgcagccagccaccggaaagtgaggacaattttgcttctgctggcagagaaagttgtttcaagacatcactgatccggctatccagtaaccaaagtccctgaatatccagcacttcctgcaattctgctagccgattgaggttcttgtcgctaggatcagtttccaccagacgggaagcatggtgaaatgccttgatgcaatccgcctgttcctttaccccttccgacacaaaatcaaataccgtgccttctacatcacgaggtgggtcctgctgtaaacgggcaacaatcaaatcctgctcataaataacctgaccatcatccaatggctgctcttttgccagtacgcgcagcagggttgatttccctgctccattgcgaccaaccagacacactctttcgttttcttctatatgcagttcagtatcatccaacagcggcgcatcactgaatgataaccaggcaccggagagattaatcaatgacataatattatttttcctcgccggcgtgacgcagtaaccagcagttatgaatctggcggttacgggcaaaatcctgagataccgttttctctgtgatttcttctgcaaccagtcctaatttatcaagttcagcaaaatccattttgaaacctcgcttattgttggagaacatcagggttccgccacgacgaagcagacacttaagctgtttcatcagagtaatgtgatcacgctgaacatcgaatgagtcttccattcgcttagagttagaaaatgtcggaggatcgataaagatcaaatcgaattgctcgcgactttgcgccagccatcccaaacaatcagcctgaatcaaacgatgctggcgtccggacaagccattagcctgtaggttcttctctgcccattcaagataagtgcgggacatatccaccgtggtcgtagacctcgcaccgcctaatccagcatgcactgtcgctgaaccggtataggcaaacaggttaaggaaatctttcccttggctcatttcacccaattttctgcgggcaatacgatgatcaagaaacagaccggtatccagataatccgtcaagttgacccagaatttcgcgccatactcgttcaccaaaaagaattctttcttttcggccattttttcatattgatttttgcctgtctgacgctgacgcgttttcaggatcagttggttagatgacaattccagcacattcatggttgcacttattacatcgaacaagcgttgacgggctttgttggcatctacggttttaggtggcgaatattcctgaacgacgactttgtccgcataacgatcaaccgcaacgttgtattcgggtaaatccgcatcatataaacgataacagtcaataccctgctgcttcgcccacttactgagtttcttctcatttttgcgcaaacggttagcataatcatctgcaataccggcatccagtgattgcggtttgtccgaaagttgataattcttctggacacaatccagcgggccatttttagccttaaactctcgttcagcgcgtaattgcaagcaactcaacaactctggcgaagcactgaataatgagagacgccagcctgggaagcggcttttcattattcgtccaaatatgctgtacaaggcaaccagtgccggctcactttcaagacgttcaccataaggcgggttgctcagtattgttcccacaacgccctccgtcaatgggttttccagcttactcgcatccccttgttgaaactggattaattgggcaacgcctgctctgcgggcatttgagcgagccatatccatgacccgacgatcaatatccgaaccaaaaaagcgagaagtcgtttcctgtagccctttacggaaacgtacctgcgcttcagccatcatttcacgccagatttcttggtcaaatttcagccatgatgtaaacccccaatgctgacggtgcaaacccggagcgccatcggcagccatcattgccgcttctatcaacaatgttcctgaaccacacatcggatcaatcagcggcgtttccgctttccagccagagcgcaaaacaaccgccgctgcaagtgtttctttcagcggagcttggccagccaaatcacggtagccacggatatgcaacccttctccactcagatcaagcgacagggttgctttttccttattcaaaaaaacatcaatgcgaatatccggctgttgtttggcaacatcaggacgttgctttattttacgtacaaagctatcaacaatggcgtctttcactctcagggcgccatattgtgtgtttctgatttcctcattcgtgccactgaaatgcacggaaaatgtgctatcgactgaaaaaatttcgctccagtcaacagattgaaccccaagatagagatccaaatcgctataaacattgaattcgttaagcggcatcaggatacgtgatgccagcctgctccagagcaagcttttatacatcacccgatcatcaccttgaaaatgaactccaccttgggcaatcttgcaggattgtgctcccagcatttccaattcattttttaataattcttccagcccacgtgccgtgctggcaaagagagagttcatgttatttttcaccacagaaagtccaccaccaaaaaaattgctgcacattatagctaataccagccacatgtcataaagttgcacaccttatcaaaaaataaaaaatatttttggagatactggatgataactctgtcacgtctctatacttacccagtgaaatcaatgcgtgggttgcagctctcacactctcttaccggtgaaagtggcttgatgtttgatcgcaattttatgattactacaacagacggcattttcatgaccgctcgccagtatccccaattagtgttatttacccctttcatgctcaataacggcatttacttacgagcgcctaatggggaaagtgccacagtactctacagcgattttaaagaagagcgccatcctactgaggtttggaacaaccattttactgcgttggtcgctcccgacgaggtgaatatctggctgagtagcttttttgatacacctgtgcaactccgctggctcagtgaagagttaacccgccgagtgaagcaattccctgatatctcactgtcatttgctgatggttttccctacttaattataaatgaagcttcttttcatgcgttgcagcaacgttgtcccgccagtatcaaaatagaacaattccgtgccaatattgtcgttacaggcgcagcacctttcgaagaagatagctggcaaaccatccagatcggtaatattatctttgacctgccaaaaccatgtagccgctgtattttaactacaataagcactgaaaaaggccgtaagaatccgaaaagcgaaccactggccacattacaatcattcagaactgctaaagagaatggcgcagttgattttgggcaaaatgccattgcccgcaatagtgggattattcgcgtaggtgataacgtcactattttagaaaagaaaatacctcgtgaatatggcaacggtgagcaagcaaaggatttgaatatacagaaagctgctgaacaagctatttcaattgaattcaacggtcagcgttttactggaaataatcagcaaattattttagagcagttggaaaaacaaggtattaaaatcccctattcatgccgcgcgggaatttgtggttcctgtaaaatatcgctgatcgaaggtaatgtgtcaccattaaaatcgaccgctattagagataatgggaaaattctggcgtgtagctgtattccccaaaatgatttggttattgaattaaactaaatacaaataatatatattatttacatagataatcaggttgtatggataaaaacatctgcctgattttttatatccagtagtactggcattcagctatactgatcgttccaacgtggactatcattgaaaaatttaagacaggaaaaatattttgagatcaaagactcaatttagacaaaaaatgttctgaatgttactgttgagtggtgataaatgacaagtgatattaacaaaatggcttaatatattaaatcactctgccatatatcgtttcccgagtcggttcaacataaggcattaaacggtcattcattatcttaatgggatcacaaaaattcattactcgatcactgagttctaatttttgttgtgctaataaacacaaactggcgctatcaccgacttctgccaccatgaatagcacttcagtaccacaatcctgtaaacgaacttgaacaatttccccctgttccggttttgtcattacagagaaactggagaaataccagctttttggcatttgtggtttcataaaacgaaatgcaactacgccattcagagctaattcagcccggagttctgatgcaatattaatacaacggaaatgttcttcgaaagcataataaagtgctgcatcatcgacagaaaaaggcatttcttccatcgtgatggcataatcagtcagcattttggcaagaaaacgggaacggaaaaccatgccattagcgagatcgagcatgacacggctgtgctcggaatcaaagtaccagcgccactgatcatcaggtctaattttcattgattacccttttatgctcaaaatagcttgtttggttcaaaataaataacactaccatagtggaaaaccagaaaaaatgataaaaattttaatctgtcagacaaaatatagacgagttgagagtagaaataaacccccaactccgaattgcggcaaatattcagatatgattaacaatatctttgattaattttggccctttatagataaaaccagagaatatctgaaccaaagaagaccctgcttccattttttctctggccgcaatcagggaatcaattcccccaacaccaataataggtattttaccttttaattcttgagaaaggcatcgaattatttctgtactgcgaagttgcacaggacgaccacttaatccaccagcctgctggcaatgattcaacccttcaatgagctttctgtccaatgtggtattagtagcaataacgccatcaatgcgatggcgcattaaactgtctgcaacttgtattaattcttcttctgtcagatctggtgcaattttcacagcaatcggaacatatttttggaatttctgttgaagttcactctgcttatttttaatcgcagataaaagatcatccaacgcttcaccatactgtaacgttcgcaaacctggagtattgggggacgaaatgttaatcgtaatataacctgcgtgaggataaattttatccatacaaattaaataatcgtctttgccattctctactggggtatctttatttttgccaatattgatcccaataatcccatcgtattttgcccgtttgacattctcaactaaattatcaacaccaaggttattaaaacccattcgattgatgatgccttccgcttcaataacgcggaacaatcttggtttgtcatttccaacctgtggacgcggtgttaccgttccgatttccacaaaaccaaaacccattgcaccaaatgcgtcaatgcaatcaccgtttttatcaaggcctgcggccaaaccaagaggatttttgaaagataagcccatacaagtgacgggtttagtggcaactgactggcggataagaaattcgaaaggagtaccggtaacaagtttgagctggcgaaaagtaagctcgtgtgcctgttcgggatcaagctggaacaatgccttccgtagtagcgaataatacatgcaatctcctgcgggcgtaatgacaggtcggggcgacggtgaaataagcgccgagcatcttaaagagatcctgtcaaaatgtaaatgtgcgggaagatatttttcaatttgttgctggtaaatatcctccggccaacgccggaggaaaaacgacaactcagctctcaagcgccttggtgattttttcaaacaaatcaccagataagttttctaacactttcaattgctccagagtagcacgcatcaaagactggcgagcctcatcgtaacgtctccaacgaatcaacggttctatcaaacgtgacgcaacttgcgggttccggctgttcaattcagtcagaatttcttgcaggaattgataaccgcggccatcttcagcatgaaaggccacaaggttattagcgaaaaacgttctcagcaacgaataaacccggtttggattactcaaactgaaagaacggttgttcatcaagctacgtactttatcaagtgcatcgaaagcaggattagttgcctgtagggcaaaccatttatccatgaccagaccatcctgatgccagcgctgctcaaactcatccatcaattggtaactacaaggcaactcagcagacatagcggcagacagcgctgcgacagtgtcggtcatattatcagcttgataatattgtgccgccactaattcatccacctgttccttgtcatcaatgaaagccagataatagagacaggtattacgtaacgcccgtttcgcaatatcttgatgatcaactcggtatgcacctgtgtgagtactgtggtaaaccgcagtgaattcatccgccatttcgttggctaatccacgtgttattgcatgaagtacatcatgaatagctttcggatcaatcaccgtgaacaattctgccatttcattttcagacggcagggtcaagatttgtgccgccaatgccggatcaatatcttgatttaataataccgcacggaaagcatcaatcacatgtattggcaattccaatggctgggattgttgataacgggcaacattcagtttcacataattagccagcagtgactgtgccgcatcccagcgggagaattcattacgcgcatgtttcatcaaaaatgccagttgtgtgtcactgtatgggtaattcaatttcactggcgcagaaaattcacgtaataaagaaggaacaggcaatgatggcacatcatcaaacacaaacgtctgttctgcattgatgatattcaaaacatgatgtattggctggccatcacggcgtaatgggatcacactgccgtgctcatcataaagctcaatgtcaagagggatatgcagcggctgtttctctttctggtcgagcgttggcggtgtcatctggctgacatgcagggtatactgctgtttttctgcatcatactcgtcatgaacggtcagtatcggtgtcccagactggctgtaccaacggcggaatagcgtcaaatcgacgtttgaagcatcttccattgcctgaacaaaatcatcacaagttgctgcactgccatcatggcggtgtacataaagctgcatccccgcctgaaattgttcttctcccaatagcgtatgaatcatccgaatcacttccgagcctttttcatagacggtcagcgtatagaaattattcatttccatcacttggtcaggacggatcgggtgagccatcgggctggcatcttcagcaaattgagcagcacgcatgacacgcacgttattgatacggttgaaagaccgtgagcccagatcagaactgaattcttgatcacggaataccgtcagcccttctttcaggcttaactggaaccagtcacgacacgtgatcctatttcctgtccagttatggaagtattcatggccaatcacggcttcaatgccaagataatctttgtctgtcgcagtttcggtttttgccagaacatacttggagttaaaaacgttcagtcctttgttttccatcgcgcccatattgaagaaatcaacggctacgatcatgaaaatatcaaggtcatattctaaaccaaagcgagtttcatcccacttcatcgaatttttcagcgatgtcatggcccaatcggcgcgatctaaattgccacggtcaacaaacaactccaatgcgacttcgcggccactgcgggtaacaaaagtatcacgcagaacatcgaaatctcccgcaaccaaggcaaacagataggctggttttgggaatggatcttgccacttcacccagtggcggccatcactcagttctccctgttcaatccggttaccattagacaacagatatggatatttggatctatctgctgcaatgcgggtagtaaaacgagccagaacatccggacgatccagataataagtaatattgcggaaaccttctgcctcacactgagtacatagagcatcgccagatatatacagcccttcaagcgccgtgtttgccgatggatgaatttcattcactatcgtcagggtgaactgggctggcaactgttcaatggataatctgccatcccgctcgtgataatgttcccacgctttaccgtcaatatgaatgcttttcagcgtgagattttctccatccaaaatcaatggagtggtatcatgattcaggcgttttacttgactgattgccgtcacagttgttttatcggcatgcagatcaaaatcgagttcaatgtccgtaatcgtgtaatctggtgcttgataatccagacgatgtttaacgagtcgctgttgtgtcatagggaacctttttcattacttttaatcgacatatttgataacatctgtataacttcagttataagatgcctagcatacttcgtttccatagaaactttctaatctctaacgctgccatagagatcccatcctttcaatcatgaaacctcttttttcggatgttaatcaattagtaaataaaggtgaaaatgatgtaagcaggatattaatgctttcgtgcgaattgtcatctcatatctcatgtaacatgatattatctgcaaatggattaaccttaatcgttactgtccggaaaaatatatgcggttatgtggctttaataacagaataatcgcggtatactcttccgactttatcgatttagcagacacgaatatgctccgcgaggatgcctaacgcgccatgaatttagacgctaccccaatcatcaaatcactgcttgatactgatgcctataaatttcatatgcagcaagcagtgtaccaccattacaggcatattattgtcgttgcggaatttcgctgccgtggtgatgaactgctcggcgaatatgccgagacgttacgccatcagattgacatgatggctgatctaacactgacagaacgtgaagccaattatcttgccagccttccgttctttaaagaggattacctgaactggttcaaatcattccgttttaatcctgaacaagtcaaaatatcggttaccaatgaaggtcaactggctatccgtatctcaggcttatggcatgaggttattctgtgggaagtccctttattggcactgattagcgaactggttcatcgccaccgttctccggaaataaaaccggaagtggccgtcagccaactcagaaaactgattgagctattccatcaagacgcggcgaaagaaaatatcgatttgtctggtttcaaactgatggactttggtacccgccgtcgtttttcacacgaagtacagtatgccatcgtcaatgagctgaaaaacaatttcccttatctgatcggaaccagtaattaccaactggcagaacagcttagtctggctcctcttggtacacaggctcatgaatggtttcaagctcatcagcagattagcccagagcttgccaacagccagcgagcagcattgcaaacttggctgaatgagtatccagctcagctgggcattgccctgactgattgcattactatggatgccttcctgcgcgattttgacaaaccctttgctaccgcctaccaaggcctgcgccatgactccggtgatcctatcgaatggggtgaaaaagcgattgctcactaccaatcactggatatcgacccaatgacgaaaacactggtattttcggatagtctggacttgcagaaatctttgaacctgtatagccgtttccacaagagaatcaacgtcatgtttggcattggtactcgactgacctgcaatattccgggggtaaaaccactgaatatcgttatcaaacttgtggaatgcaacggcaaaccagtggcaaaactttcggacagccccggaaaaaccatctgtgaagatgatgaatttgtcgataggttacgtcgagcgtttgacattccctacatagaaaaagcagtataatcttcgctaattgtcccttgcgtaaccaacttcatgctggttacgcaagtaaaaagccgcttttccctgtttttccccattcaaactcacaatttctgcttgtttcctgagagatggcaagtaagatagaagatctgctcctgatgtggggcatttacagtaaatctatctaactatctaattcactatataaagaagagagaaatttatgagcgttgcgcctgtagtcgatgtactgcaaggccgcgtcccggttgacagcgaagtcaccgtccgcggttgggtacgtacaaggagagattctaaagctggtatctcgttcctcgccgtctatgacggttcctgctttaatccagtacaggccgtcgttaatagtaatttacctaattatcaggatgaagttctgtatttaaccactggctgttctgtggaaatcaccggtacagtcgtggcatcacaaggcaaaggccaaaactttgaactacaagccaccaacgtggttgtagttggcatgatagacgatcctgatacttacccgatggcagccaaacgccacagtatcgaatatctgcgtgaagtcgcacacttgcgtccacgcacgaacctgattggtgcggttgctcgcgttcgtcatacactgtcacaagccctgcaccgttttttccatgagaaaggcttcttctgggtatcttccccgctgattaccgcatcagataccgaaggcgctggcgagatgttccgcgtttctacattggatctacaaaacctgccacgtaccgataaaggcgacgtggatttcagcaaagatttcttcggacgtgaagccttcctgaccgtatcgggtcagttgaacggtgaagcttacgcctgtgcattgagcaaaatctacacttttggcccgactttccgtgctgaaaactccaataccagccgtcacttggcagagttctggatgcttgagccagaagtggcttttgccgatctgaacgatatcgccagccttgccgaagagatgctgaaatatgtcttcaaggcagcattggaagagcgtgctgacgatttagcattctttgcagaacgtgttgacaatgaagttgtcagccgtttagagaaatttgttgattccgatttcattcaattggattacaccgcatgccattgaataatttggagaattcgtggccagaaattcgagatccctgttttctggggcgttgatctgtcatcagaacatgaacgttatctggcggaaaaacatttcgaagcgccagtgatcatgaaaaactatccaaaagacatcaaagccttctacatgcgtatgaatgaagatggcaaaaccgttgcagccatggacgttctggctccgggcatcggtgaaatcatcggtggctctcagcgtgaagagcgtttggatatgctggatcagcgcatggaagaaatggatctgaataaagaagattactggtggtatcgtgatctgcgtcgttacggcaccgttcctcatgcaggttttggtttaggcttcgagcgtctggttgcttatgtgactggcgtgtccaatgtgcgtgatgttattccattcccacggacaccaagaaacgcaagtttctaatgaattagctcaataattgggcaaaaattaattctttgaaaagtcaacgaaagttggcttttttcattttatgattcaaaccatacgaaaaaagttccctgtaatttacattttgaaatatttatttacaaattgttaccaattattcgattttgtagcattttgagggtagataaaattcattaccaatggaacactggtcgccgactaataagacactcaatgtccataaatagttccaaaaatttttagtgttctatttctggcagtggccggtgtcaacataacaccaatgagggtaataataatgaaacgcaatcttcttgcagtggtaatcccagctctgctggtcgctggtacggctaacgcagctgaaatttataataaagacggcaacaaactggatctgtacggtaaagtagacgttcgtcatcagttcgctgacaaaagaagcggtgaagatggtgatgattcctacgcacgtctgggcatcaaaggtgaaactcaagttaatgaccaactgactggctacggtcgttgggaatacaacatgaaagctcacaaagaagagggtaaacaagactatgctactcgtctggcttacgctggtctgaaatttgctaactacggctcactagattacggccgtaactacggtgttgtatatgatgttaacgtatggactgacgtactgcctattttcggcggtgattccatgtctcagactgataactttatgactggccgttctactggtctgctgacttatcgcaacactgacttctttggcctagttgatggcttgggctttgctctgcaataccaaggacaaaacagcgatcgtaccaaaaacgagcgtactgaaccaactaaagccaatggcgacggttatggtttatctactacttatgacgtaggctacggtatctctgttggtggttcttatgctaactctgcacgtaccttaaacagtcagcagcataacgccgatgctttcggcaaacgtgcggaagcatggaacatcggtgctaaatacgatgctaacaacgtatatttggcagctatgtacggcgaaactcgcaacatgactagcgccaaagtaagcggttttaacgacgaaggtaaactagttaaaggtgatcttatcgctaacaaaactcaaaatgttgagttagttgcccaatactatttctctgacttcggcctgaaaccatctctggcttatgttcagtctaaaggtaaagatctgggtgaaggtgaagacagaatcaaccacgatctggttaaatacgtttctgtaggtacttactactactttaacaaaaacctgtctacttatgttgattacaaaatcaacctgcttaagaaagacaacgatctgggcatcaacgctcgcaacgtattcggcgtaggtctgacttaccagttctaattacagttgatgaattgtttagctcaaggttaaacaaaaccatctctgaaaagcagcgcttaggcgctgcttttttacgttttactttactgttttttatgacatttttttcactccgtaaactacttcacaagattgtcttctttttgctacaaattgttggcaaacgagttccttgaggttaccctgagcggtgtataacttattttttgggcttaactctccgagtcttggaatcaaaaaaatgtttgaaaaaattacagcagcacctgccgaccctattcttggtttagcggatagctttaaagctgatcctcgtgaaaataaaatcaatctgggtatcggtgtttacaaagacgaaactggtaaaacccctgtcctgaccaccgttaaaaaagcagaaaaattcctgctggaaaacgaaaccaccaaaaattatctggcaattagtgggttacctgaatttggccgcgtcactcaggaactactcttcggcaataccagcactatcattactgacaaacgcgcccgtactgtacaaagcccaggcggaaccggtgcactgcgcactgccgcagattttattgctaaacagaccaatgcaaaacgtgtctggatcagtaacccaacatggccaaaccataaaggcgttttctctagcgctgggttagaaatccgcgagtaccaatattacaatgcagaaaagcatgctctggattttgatggcatgttggctagcctgtctgaagctcaagcaggtgatgttgttctgcttcacggttgctgccataacccaaccggtatcgatccaacggctgaacagtggcagaaactggcagatttatctgcggcaaatggctggctgcctgtgtttgatttcgcttatcagggttttgccagaagtttagatgaagatgcagaaggcctgcgtatttttactaaaaaccataatgaactgatcgttgccagctcttactccaaaaattttggcctgtacaatgagcgtgtaggtgcctgcaccatcgttgcaactgacagcgataccgcagaaaaagcattcagtcaggcgaaatctattgttcgtactaactactctaacccaccggcacacggcgcttctgttgttactacaattctgtccaatgacgaatttaaagcagaatggattcaagaactggcgactatgcgtgaacgcattcgtcgtatgcgtcagctgtttgtgaacaccttgcaagaaaaaggtgcaaaacaagactttagctttattattagccaaaatggtatgttttcattcagtggtctgactaaagaacaagttgatcgtctgcgtgaagaattcggtatttatgcggtcagctctgggcgcattaacgtagcgggcttaacactggagaacatggttcctctgtgtgaagcgattgttgcagtactctagtttttctgagtagcaagatctccctcaatcacaaagccgctgaaaaagcggcttttatcttccgaacaattaaaaacgcattaatcaatcttgcaggaatgggttagttttacgttcatgacccaatgttgacatcgaaccatgtccgggaataaagtggaaatcatcacctattggaattactttttctttaatggattgaatcaaatcatcataattaccacccggaaaatccgtgcggccaatactacccttaaacaacacatctcccattgagattaatttatcggtatgactgacaaagatgatatgccctggcgtatgccctgggcaatgcaaaacagagaattcgatattaccaatctgcaatgtatccccttcatccaaccagcgttctggtgtaaaagatgggcatgcctcaacaccaaacatctggcattgaacttccagcgcttctatccaaaaagcatctgctttatgaggcccatgaacaggaacattgaagtgtgtagcaacgtcaacagtagcgccaacatgatcatagtggccatgagttaacagaatttgcgttaatttcagtccacgttgctctatttcagaaataagtttttcagcctcaccaccgggatcaacaattgccgcttccagagtttcttcacaccagatcaacgtacaattttgcatcaccgtagttacagggataatgtgataattcattatattgtttaactccacgatcaagacaaatacctgataataagattaccacgtcctgactgggcctgtatctatatgaataaaattactctttgggtaaaacccaacgccccccgctctcatcttcagtgcagctttacgaatatgtgcgagctgaacactatcgatatgaaaatccattgcttgcccacgggtatgatagctacgttttgcgacaccaccactagcctgacgcaacatattatttgtcgtcaatgaacgataaccagacaccaattgaacaggtttatttattcctatcatcatctgcaataaataaatctgatcaaacagtttcggatcaatagatttgattttattttggcgataatcgcggaataaataattcaaacgagccaattctgacttgttatagcgacgaccatcaaaaaattctgctttgagtgtttcccccgtgtgcaaattatcaaaacgtaaaattcgaggacgtggtgttgtcaatgcggccaatgcgtgttgaggtaataaacttaaccccaacgcagctgcacctataccaagccactttcggcggctatagtcaatatcattcatggattaatatgccctgctattctatggtgtatcaataatttctaaattaggtgactcattgagtttaaccgactaataagacagcaacaaacaaaaagtagttttaataatttttgtatattactgtaaatttaccagtcaataattgtgaccaatctaacataatacaaataatattaaatatagatgaaatattaatgatgtcgtgttattacaaaattttatccatctgaatcatgataaatttatcaatagcagagaaaaaatcacattaacaaaaggtaattatgagaaaaaatagagtcaaaagactggataaggagaaaataacagtgaggaaattagcgctatttccctcactgtacagacattaattttaaactttcttctttcattaattatagaaaattatgaatcatttcgagttgctaggatctcggataaaagttcagactgctctctggcactcatatcataatcataaatatctgcgcggtattgaggcactcctccttcatcaacccaagccgtttgataatagagaaataccggaattttcttcggaatattcacatatgctgttgtccatgtttttaaggaattacttacccgatccttattccaacctgcattccccaacaacatattagccaattcaggagccttattaacacgtacacaacctgaactgaccgctctcatttcccggccaaatgaagcctgatttggcgtatcatgcaaataaatcgcttctgagtttggcatgttgaacttaaaacgccctagtgaattagttggaccaggcgcctgccgtatacgataaggaaaattatttggtgtagtcacgtcccagttaattgatgaaggatcgataaccttggcatcattgctccaactggaaaaaacggtataaccacgactacgaaaataactagggtcacgcattgctctaggtgcaatatccttccgtgtcatactggtaggaacagtccacggtgggttaatcaccacattattcagattactgctcatgataggcgtttttctgctcggtcgcccgacaacgactttagaattcaatacttctttaccatccagataataaaataatgagtagttgggaatattgaccagtatacccgtaggaatattatctggaataatacgcagcctctgtatattcaatgccataattcgagcgcgggtttgtggcgtagtattcagccatactttcgtcgactgcccaataacaccatcagccgataatccatgtaaagcttgaaaacgttttacggcagccactaattctttattgtagaccttgttttcaggtttgactgttaacgaatccaaagtatcggaacgaattaatatttcccttaacgccacgacactttcactattttgtcccggtcttaatgttcctttcattgaaaaatcagaccactgctgtttatcagccaattgtttcagcatctccttacgcatatttttatacatagggttatttggtgacaatgcagtgatgtaagaaaatacattattatcagtaatatgctgttgccatttatcaattaaatcaggaggcggtaaattaatcttataagattttttactgtataaccacgaatctccttttttcttaacatcattgacaaaatgcagatagcccaacatggcatctgataaaataacatcacgtcccatatcgcttaattcagcagaatgaagttgagtcagccactttccaaattggggttgaaccccggccaatgatagttcaaataattgctgttcaaactgttgaaccgtatttttatcttgccatagcggtttcattttattgactgcatataacgttgccaaacggtcaatgaatattggttttacttgttgcggtaaccaactttgtatctgttttcggttttcttcaatcgaatttactgaagatataggaataatctgatccggtgaaacaactacgtcttcctttttttgttcctccaaaaattgttgggtatcatttactatcagtccattttgttgacttgcaaaggtttcctctgataccgccaacgcgctacagataaaagaaactttcagtaacctgaccgtgttcttcaccataaaacctcaccttaccttattatacatgcagctatccaatgacttattttaattatcagtagacttgttttattgagaaagaatagtggtaattatatacataattatctattaagatagaagcatatcatcatagccagtcaccccgggtaaaaaaaaattttttattataataaattagcttatgttagcactaaaaaagaaaaaggcaccttaagtgcctctaactaaagttcattctgtaaaatctttcggattaatattcggatttaatgactacttcttccccaaagcggccagctttaggcagaggctgataagaagaatttgatgctctcaaaatacgaatacctctgatattcagttcatgggcagcagcaatatcagcatctgcatcgccatagtagagctttaatttatgttctttcatccagctgattttattattttttcctggatcatcacctgcaaaaataacgacattcattttgtcagcaggaatatgtaggtcttcctgcaaatattttgttactgtttctgttttagttttcgtacgccctgtaatgaaataaatattatctccccgttttaaatgcatctgaaccaattcaataccgatttgtttcggcatactgaattcatcccattcattattcattttttcccaaaatgccggatttttcagatagctattgtcatttggtgaatatttcaatttaccacgataaaaaccagggctggaaaacaatacggtgtcatcgatatcaaaccctatcgccattggcggctgatcttgcaggcttttttcaatctgctctactgagacccaatgtacagcctgacgctgagaaagttctactgtagttacccctgagctgactgattctggcatttgtactttcgcctgtacgacaccgtttaagctaaaagcaaacgcaatggcactgaatactaacgttactttacgcatcgttattcctttttatattaatcataacgatgtgagataatagacgttcttatcgcactaaaatgagacacactacacaataacacaaggttacaatttattcataaactcattataattctttatttattaaaagaataataagctgattcaagggaatctatatcatcccctttcaaataagggagcaatttttccaccatatcttcatccagatcatacattttcaacgccagcaatctcgatataacagaaggttcaaaacgatatttaatgaatcgggcaggatttccacccactacggtatacggagaaacatctttcgtgacaatactccccgcagcaacaaccgctccctccccaatcgttacgccaggcatgatcattgaacgcataccaatccaacacccatcagacaaaattgtatcaccggaatgttgataggattctttaataccttccaaaaaaggatagacagaaaaccagtctattcgatgagtatggttgcctcccatcagaatgacagcttctgatgcaatacagacataatttcctatataaagcttatcaacgacacctaaaggttcccatccaaggctgatttcatcaccatgaagataacggacaacactcttctcaaaactatcactccagcagtgactataataactgtgtgtgcctttaatctttatattggggttggttactgttgaatgtaaatattcaacttgtgaccaatgtttttgattctcattcataaataattacctaaagaagtagtaaattaaaaatcattccctatacagctcaatcgtcctaacaaattctataactgcttgatggtcatgtgttatatagaaaaaactgattttccccatcatacccgattataaaacccaaatcgaaaaacgattggttattctaaattggaagaaatgcacgataaagtgatagggacttctattgaacataaatactatgtttaattggtaatctaactattgaatacggtaatctcagcagggaggacatatcataatatggcctcccttaaatatagaaacattacccaacgccagaattactctgccaagatgggttgaagctgttcaatggcgggagcatcctgtccaaaaccacgcagaccaacaacatgcacatgttcatgattattaaatattttacgtactaatttatacgttgtacctttttccgggctgatgttttccggcgctgcgataattaactgcatctgcaaacgttcgcacagttcaaacagcgtggcgattgatttcgcatccaaacgcgccgcttcatcaaggaacaatagacggcatggtgatatgtctttaccacgcaggcgccgtgattcctcttcccaactctgcacgaccataaccagaattgacatccctgtaccaatggcttcacccgtagacaatgccccactttcagctttgagccaaccatcagagccacggttgacttcaacgtccaattcgaggtagttacggtaatccagtaattcttcaccaatggtctgcggtaaacgctgccccatgtcaatttgtgggttcagacgctggtaaagtttcgccatcgcttccgagaaagtcagacgctggctcttgaacagatcctgatgttgctcctgctgttcagaaagcacatccagcaagattgaatggctttcacgtacattgacgttcaaacgcactcctcctacctgaccaaaagaaacagcctgcaatccctgattcaacatgcgaatacggttctgctcgcgctgaatcgtcttgcgaatgatattggccacactcttggaactgatcgccagtttttgttcacgcgccgttaattcttccgtcaaacgagccagttcaatttccatctgttcaatggcatcaaccggatcatcggtacggataatatcttggcggatacgctcacgcagatgttgataaacagcaacgaaaaattgaattttacgttctggacgtttgggatcttcagacaaacgcagtgcatcgcgcaggtgttcattatttgccaccgccagacgcaatgctcccagcgctttatccgacattgaacgcagctcatctccattcatataggccagttcgcggcgatggaggcgacgctcaacaccattatctttcaccagccgcataacagcacaccagccagcttttgaagaaaccacctgctcgcgtttctgataatagtcacgctcagttttacgcaattttttctggaggttttccatttcggcctcacaaaatgcgatctgtttctcaagctggttgatgcgggaacgattggtgctcaaggcagcgtgaagctgatcgcgacgttcacgggctcgactttctgcattcggatcggcctgaacaccgatgtctttcatctcctgctcaagttccttcaacatatcctgcttagtgtcataggaactcttcaatgaggccaatacttgattaaattgggcgtattgtgattgctgctggcgcaattgttcacgcgcgcggctgcgatcagactccgcatgttcaaggcgctggcgcaatttatcattcagatcagcattgtcactgagcatccccacagaatcgctatagctgaaatgcgcacgacgctgcaccacttccgtcaaagcaaaagcttgctgtttcgctttattctgggtgtgtttcgccgtctcataatcctgcttcaactgctcatgctgctgtggatcactttgcaggacagaaaccaacggttcgagtttgttcagtgcatgactatgctgttgcagaaaacgagccgcatcttgtgcttcactcatttcttcacgcaccgtttccacacggtcaatcagcgtttcatccagcaagagggtaatttgtgggatcaggcggttcagcgctgacagactctcttttacctgaaccagtttctggtgatgctgttgagtctgtgcttcaaattgagagagttcgcgctccagttcaattcgctgctgattcaagctacgaatatcagcttctggatcgtcatcaaatgcaactgacagatgtttgcccacaaaacggctgaaagcctgataggcgcgctggattttctggacgtcaaacgaaagcgttgcatagcgttctgccagcgtatcacgttcaaaattcagtatttccaggcgattttcccttgcagcccttccaaacagcggaacgtcaggataacgggaataacgccactgacgatccgatgattttaccagaacagcatttttccgctcttcgaaatctaagacgctatcatcaaaggattgcggatcgccttcaatcagataaagatcttccgggcaatcttccagtgcttccagatgtggacttaccaacgaaagatccggcacaacgatagcgtggcgggctggcccgtacaatgcggagaaataaggcgcatcatcaatggtgatgtcatcataaatttctgacagcaaaacaccaccaaaacgttccgccaatgcaagcaatctactgtcttcggcaccacttggctggctcaaacgctcaatatgcttttcaagctcacgtttctgtgctgacacatcatcacgttcgacggtagtttcgcgttcttgctccaacaattgttgcatgtattcagtgacatcattggcactttcgaacgtttcaccgctctgctcacaaagttggttcaatgcatcctgtgccgtcagccaaactggtgctcgtgttgtcaatccctgaattttctgcttaagctgttccagctgctgacgcatctgcatacggcgctcgccgctttcactggcattcaggcttaactcttccgagcgggcttccaattcgccctgcaacgcttctaaatcttccggttggtactgctggttgtggcgcttacagaattcccccagtaagcgctctgcattttgctggctgttcagacgctgttccaattcagctaattgaatacgcagaggctgaacacgatccgccagatggcgttgggatggccattcgcgcagtacttcacgggcactttgccatgctgagctacggctcacctcaccaacaatatttttcaccagttgataagcctgctcaaactgactatgggcagcatctgccacactcagcttctgctccagcgccagcaaggtttcagtcgcctgttgttctttggcctgataggtttcctgccactcatcagcattatctatcaataaatccgggagctgacaaagctcacgggcacgttccagtgcttgcagcgcctgttgatattggatcgagcgagtttgttgaacatccaacgcctgctgatagtcagcaagctggctttttaattcatcaacttcctgttcagccgcctcagacacggcgtcatattctgcctgtaactctttcgcttcttcgacaacttcagtctgttcttccaggcgataagtcagttcttcaatatctccttgataacgatctattttctcctgctgacgcatggctgtctgaactaaattcagatgatcgctagccgcctgataatccatctccaaatcagaagacgcaccactctgctctgtaagctcccgtgctatttcgacatggcgatactgttcagccactaattgacggcggctaccaaataactcactacgcaaagccaaggcttcatctaggtggatacggcgctcattggtatgacgcatgtagtcagcagaaacataagctgtcgcttccgtgatgagatgtttaaacagatcgcgatcagattgggtaacgcggattgcttccagcgtgatgcggttttcacgcagtgccgcttccatgtcctgaaacgcttttctaacgccgctgttttctggcagtaaataatcacgcagtgagcgagtgatcgcgctggaaataccaccatataatgatgcttctatcagacggtaaaacttactacgatcactggccgaacgcagacgttttggaatcacccccaaatcaaacatcagggaatggtaatcggtgatagagttaaattgtttgaactgaacaccttccatctcatcaaggcgctctttcagctcatttaatggcagaacccgcgcctgacgttcgccaatgttttcggtcaataactgcgttggctgtatcgatgcagggacaccctggatcatgaatggtttgatatcaaccttgcggtcgcgcccggcaacctgctgtaagcgaacccccgcaatgatccgctggtggcgggagttaacgacatccagtgtagaataacagaccccggcacgcagtttaccgtgcaagcctttatcacgggagccactggttgcgcccgcttccgtggtgtttcggaaatgaagcagcgtcaagtcagggatcaacgctgttacaaacgccgccatcgtggtggatttacctgcaccattaccaccggataaggtggtcacgagttcgtcaagatcaaacgttctggcaaaaaaaccgttccagttaactagcgtcagtgagcgaaatttaccgcgttcaatcatgactgttcatcctccgcaccttctgctgaatgctctgatacttcttcgtgttcattatcttcctgcgataaattgccttccaccgacatcgcttcaccatcacggatcattcgtaattgtgcttcacgtgggttgtcaccactacgtacatctgctccaaagcggaataccgtttcagtaatcgtaaatttattgctgtcattctgcaggaaatagaccattcccaaacggcgcaggcggtttagggaagttcgtgctttttcctgtagtttttgtttatccagatcggagcctgtcgaacgttggttcaccaatttcatcagtttactttcgtcagcgagcgacaatagctcgtcatacagttcctgaaaggtaaatattccctgattggacagacgttcagggctgagatagaggtaacacaggattttacctaccatcatgtccatttcagacagaacagatcgagggatcagcgtcgttgagcgtggacgcaggtagaaaaaaccttctggtgcacggattaactcaacattatagcgagcataaaacgtttccagctcctcctgaaaatccatcaggaaagcatgattatcaagatcatccatcccaatgtgacgccctgaacgaagctggctgtctaattcaggaaaaagtgtgttggataatgcctgagccagtttgaccggcataaattgttcaatatgtgtcgatgacatgtgcctgcaccttggctccgtaatcattaatcgctaaccattccgctggcaacccagagaaatccgcttctgcaacgcccagccgtactgcctgatccaccagaatacgcgccacatcgaaatggcggttatgtggatattgagcaagataatcgcgcagtactgcccccaaatctaatgggagcctgccctgctggtagacgccagagcctgctccaccatctcggccaattgttcgttgatttcactaaaattcttcatattccatgtctggcggtaattctcccattacctcttcattgcgcaatgtcagttcttcgtcgcgcatatccagcaaacgctctgcattggcgatggtcagcacccacggatgatcaaaatagtgttggatagattggcggagacgttgagcaaatatgcggttcttatccatatcgatagcggtacggataaatttgtgaacgtggcgatcatagccaatccagagatcgatagcctgttgcccccaactaataatgcggtcgagtttactttgcagatcaaaaaccagtttatccaccaattctaagccaccgctacccatattagcatcctgaatacgcagtagattggcctgtaatttatcaccagcagcttccaacgtatcctgaagctctctcaatgtacctgacgtttcagacagtaaatgctcgcaattagcgatagcagcctgccaatcttgattgaggagcgcagcaatgtctatttttacgctgttttgctgttcatccatagtacgctgtgacatatcgatgctgtcaaaaatttcagcgacggaatatttgagcggcgcaaaaacattgcggtgccaatggaactcatcgccaccttcttcagcagcttcagccgcccgatgtagttcgttggcgacaatggataactgcatggaaaggcgcaacgtggaaaattcgcgctggcgaatataataatcactgatgccaatacccaatggcgtcaagcgataaatagcattgccatccgctaattcactggtaaagcgattaatcagcttttggcgtaccatatcgttaatggcattattcgcccggacagcaaccgcctctgacgtttgctcaaaacctttgcaaacttcacggaacgcatcaaccaactctccctcgctcatttcgccatcaaaacgttcactgttcagcactgagattgccatcaaaaaagccaagcgttccggtggcaatgaaatcgaaaaatcattctttctggcccaggacacaagttcaggaacagtctgggaatattcactcataattcactctttaaagtcggcttgcgtgccatcacatgaatgtaacgccccaggctgatatagggctcctgtctgcaataacgttgttcaagttcaagcaacgccggaaaatctgtattttgtaattggcggctttgcaggtagtcgtgaaaaaccctgacacctgttttgcctgttatttccatattgagttcagtaagccactgatatacctgttcgggtactaatgggttctgtggcgataaagaacgctttcggcgacgctgaatatttggcgttgccaaatgaaagttacccaagatggcattacgcatgaccagtccattagcattataaaacattaatgaaagtgctccaccgggtgttattatctcccccaatgtttctattgcatctttttggtcagtgatccattccaatacagcatgaaatagaattaaatcgacgggttgtttaatgtgttgacgaatatcctgtaccgggctttgaataaattgcatctgatggagaacaccccgctcttgtgcattacatttcgcccgcaagatcatttcttcagagaggtcacataatatgaccttatggcctaatgcagccaattggcaagccatgtttccttcaccgcctcccgcatccaaaatgcgcagagggcgttgaggtaaatgattcagcaattcgttgatatcctgccagacaacggcctgcctgattttacccttggttgtgccgtaaatattacgtgaaaatttgtctgcaatatcatcgaaattgcgatcccgcatgaaaaactgcctcactgataagctaagtttaatttatttattgagtaataatgctggctactgttattttggcacagtaatcattgaattcactacttttagccctaaattcgaccccgggcggctataattccaccaaaccaaggccaatcaatgttatttctgcttaaaaaatatgttggcgcgctattaatgcctttgcctttgattattcttgtttctttgacagccctgctatttctgtggttcacccgctggcaaaaaacgggtaaagctttactgtcactgagttggcttgcgctacttttatttagtttacagccgattgctgacaaacttttacttcctatcgaggggaagtatgttcaacgctacgagcctgacaaagcatatattgcccccgtaaaatatattgttgttctcggtggcggtttcacttacaacccacaatgggcgcccagtgccaaccttatcagtaatagtctgcccagagtcaccgaaggtattcggttatatcaccttaatcctggcactaaaatgatttttacgggtggtaaaggtgttaactcaatcagtagtgctgaaatcgctgctatggtagcacaatctttgggaattcctgtagaagacacgattgcattaagagagcctttagatacggaagaggaagccgctgaagttgaaaaagtgcttgggcaacaaccttttattctggtcacttccgccaatcatatggaacggtcgctcaagttcttcgaacggcgtggtatgcaccctatcgccggccctgccaatcaactggctgtgacaactccattgtatgcatgggaaaaatacattccatccgcctattatttttcacatacagaacgagcttggtatgaaacgttgggtaaaatctggcaggcaataaagccagtaactaaagaggcagcaaccgaaaaaacagaaaactcttaatagaaaacagtgagagtcggaatcatactgaaaaaagagaatgccgcagaagcggcattctcttttgactgttataccggataacgtgttcagcactcagcaaaggtttttctgacggcttccaaatcttcaggtgtatctacccctgcacctggcgcttgtagcgctttggcgacatgaattttctcaccgtaccaaagcacccgcagttgttcgagcatctcaatgctttccaatgggcttggcgcccactgcacgtagcgacggataaaccctgcccgatatgcataaagcccgatatggcgcaggaagttatccccgactgtttcttttgactgcataaagcgatcacgttcccacgggatcgtggcgcgtgagaaatagagcgcataaccttgcgcatccatcacaacttttacagtgttagggttaaatgcttcttctgcatcttggatctgtactgcaagtgttgccattccagcatcactttctgccagattatcggcgacctgcttgatgatttgttctgggataagtggctcatcaccttgaacattcacgatgatttcgtcatcagaaaattggtattgatcaatgacttcagctaaacgctctgtacctgaatggtgatgcgcacttgtcatgcaagcttcaccgcctgcggcagtgacggcatcaaaaacggcttggttatctgtcgccacaatcacccgattagcaccggagcggatagcccgttccataacgcgcacaatcattggcttgccatgaatatcagccagcggttttccgggcaggcgagttgaagcaaaacgcgctgggatgataacggtaaacatgaattatttttcttcctctgctggcagggcccgtgcttcattttctaacagaacaggaatgccatcacggacgggaaaagcgaggcggtcaagtttgcaaatcagttcaaagttttctttatcgtaattaagcttaccgtaacataccggacaagcaatgatttcgagtaaacggtgatccatatatcccccaaatgacgggcttcgaatttaatgcggttcagaataccacaagctatgtatcaccgttaactctgttattttgttgaatgctgtgatgatttaccaagattatctgcgcatattcaatttaggaagtaaagcacaaatttcatccagcattttttgctctttttcttctggaaaatgtgcagaaaccggtaaataccaccaattaggctgagcgaattggaaacatttaactgcatctttttctgtcatcagcaaattctgcccatcatcggtcagagccgacaattgagttttatcataagattgatgatcagcaaaagcgtgtgtttcctgcaaaacagctcccaactgctgcaaagttgcaaaaaaacgcggtggatgaccaatacccgccattgccaccccattgggaatatcactgacctgacgcgattctcccgtcagcaggttaatcgccagttcaccttttaatgtcatgggcaattcgcctgtttccggcactcccccattaacaataatggtattaaccgtatttagacgaccagcgagttcccgcatcggccctgccggtaaccagcagccattaccgaagcgacggataccatcaatgaccacaatttcataatcacgctgtaaggcataatgttggaggccatcatcggtgatgataatatcgacggggaaatgcattaataacgccttgatagcgtcggcgcgtttcggtgcgaccgcaacaggtgcaccagtacggcgatgaatcaaaactggctcatctcccgcttgtgccgttgtcacttcacctgttatcaacagtgggtaatgttccgctttcccgccataaccgcgagaaacaacaccaatctgatagcctgttcgctgcaattgttcaaccaaccaaatgacgattggtgttttgccattccctcctgccgtcaagttacccactacaacaacaggtacaggcgctttccaggaacggatcaaccccagtttatagcctaaacaacgcagaccgcttatcagcccataaagggctgacagtggcaataacaagatgtaaagccatgaacggccggaccatatgcgttcaatcattgaccaaattgcatccgatgtaattgggcatatgcgccatctttttccaacagaaccgaatgattacctttttcgacgataaaaccgtcttcaacgacgataatttcatccgcattttcaatggtagaaaggcgatgggcaatgaccaaagaagttctgtttttctgcaattcatccagcgccgcttgtatggcacgctcagattcagtatccagtgctgaggttgcctcatccagaataagaattggggaatcacgcagcaacgcacgggcaatggcaatacgctgacgttgtccgcctgaaagcaggacaccattttcaccaatcatggtatcaagaccctgatccagtttcttgataaaatccatcgcataggccatttccgcagctcgttcaatttcttcacggctaaattttccttcgctggcataagcgatattattagcaaccgtatcattgaacaaatggacattctgcgataccagcgctatctggctgcgtagtgaagacaatgagtattcacgcaaatcatgcccatccaacatgatgccgccttcattgatatcgtaaaaacgagtgagaagattggcaatcgtcgattttcctgaaccagaacgccccaccaatgcgacagttttacctttaggaatggtcattgagatgcttttcagcgcaggatgatctttggttggatagcagaatgtgacattacggaattcaagatcaccttttgcttttttcagctccagcttaccttcatctttttcctgttccatatccagaatcgcaaataatgtttggcaagcggccataccacgctggaattgtgcgttaacattagtcagcgatttcaatgggcgcatcagggcgatcatggatgaaaataccacggtgattttacccgcagtcagtgcgcccataatttccgggaaactggcagcatagaggacaaacgctaaagcaaaagaggcaattaactgaataatggggtcagaaatagacgacgccgacaccattttcatgccttgctgacgcatatggttactgacttggttaaaacgtttagtctcaatcttctgaccaccaaagatcaaaacttctttgtgccctttcagcatctgttctgcgctggttgtcaccattcccatgctgttctgcatatttttgctgatattacgaaaacgtaccgaaacaagacgaataacaagagcgacaatcggagcaatgacaatcaagatcagggaaagctcccaactgtaataaaacatcagaatgaacaggccaataattgatgctccttccctgacaactgtcaccagcgcgccggaagaagaagaagcaacctgttctgaatcgtatgtaatgcgggaaagcaatgttcccgtagattgctggtcaaaaaaggaaactggcatacccatcatatgagtgaacagacgacggcgcacctgcatgacaactttgccagatacccaagatatacaataacttgatataaaacccgatatgccacgcaaaagcatcagcccgataacaaccagcggcatccactccaatacgctcatgtctgccttgccaaaaccctcatcaagtaaaggtttcaacaaagaaagcatcaatgtatcaccggcagcatttataaccagcgcaatcgccgccactgccaagcctagcttaaatggtgtgatgagcggccacaatcggcggaaggtctgccaggtagaaaggtctttatcattcattattgagttaccaaaaccaaaagaaatagcgggtcattctacccatgatcgctatgaataccaaaccactgatgataccaccgtgacattatgtgttgtctataacctgctaatttaatgtgatcacgataaaaataaccggtaatctggccggaaatcgcagtgctataccattgaatttcagcgtttttataacgttgtcgtactttcacggaaggtaacttccacgggctataacgggcaaccgaagttaatgcatatttaggcatgattgtgcgtataaataccgctgtggacgaagtattgctcccatgatgaggaacttgcaatattgttgcattcagatgttctcgttcaagactgactaagcggtattcaccctgtttttccaaatcacctgttaataatagactgtgtttaccatcatcaatgcggatcacgcaagattgattgttaccgacaaccgctgttttttcttgcggccagatgacctgaaacgttaattcctgccaggtccattgctcaccacgaatacaaggcaaatgtgattgcccgatcaaagaactcctgatttgaatatcaggatattttttgcgcagatattccacgccacctgtatgatccaaatgatcgtggctgagaataatctgttctggtgtcaaacgatgccaacgcaaataaggtgcaatgactttttctgccatacttcccgtttcccaacggtttcctgtatcaaaaatgattgcctttcctcccttgtcaatgaccactgccaagccatgtccaacatccagcatcgaaaaacgccattggtattcatcatcgcgttttaaataacaaacaatgattccaatcaagacccctaacagccatttataagacttccaccagcccaaacgccaaaaaacgacagaaaaccaccccacaagcgtgataaagatagggaaatgccctgtttcaaaccatgaatgtgttaaaacctgcaaaggcgccaaagcgaatacaatactgtaatcaaccaactgccacaaaattggctgaataacaggaagaaagaaacaggataacgctaacatcaccagtggcacagacaagaaagaaactatcggtacagcccataaattagcaaccaatgatgcaatattcagcccctgaaacagtaaaagctgcaacggcaacaacattagcatcattcccaattgcatatgcagcccacgtagccaactccaatgccagccataacgaatgccctccggtaagggcatccagtgaaaccaaaataacaacgccatcaccgcagtaaatgagagccaaaagctgtcagaaaggattgccagtggatcaaacaataaaatcagagctgcactccataaagcccactgccatgaaaaacaaaaccgatttctgcaccgcagataaatccaaagtgttaatcctaatattgcccggacagccggaattccccagcctgacaaccaagcatataacactgcggtcagccaccccatgagaagcgggaaacgaaaactcacccaccttgccggaaagaaaaactgaatgcccctggcaaggctccagccgaataaactggccattgcgatatgcaaccctgaaatagccataagatgagcgatgcccgtttgctgcaacagcagtctggtttgttgatccagccactttctttcaccaaaggtaagagccagagcgatccctgaatatttcaatggttggatttctggcaccagtttatttatcaaatcttgcctaaaactgcactgacctcttagtaacctagccttagtaattttgccattaagtggctgacgaatcgaaagtgcatatctctggctatcatagcttccatggttcaattgagcatgaaccggcctgagtttcattgtgacctgccatatctgaccagcacacagcgattcagaagaattccatagtaccgatgcaaataatgcaggaaaaatatattttccatcactttcaatgaatctgatgcgatgacgttctgtttcttccgcattatttttctcagcatctaaagatacgctctcaatcatgaccgttgcagagcgggatgtttcgctgaaataagtgatttgattcaatatcaggtgaccatgccaacatccaaaaataaatgtccataacatcagcgaagttatccgagcggatttccggggaacaaaccataaacaaaatgccagcccaatcaggaaataaatttccctctgttgaggtagttcagcgagcaataataaggggaacattcccagaataattgctatagcagcctgattcagactgataataagcagcggctttcgccaaatggagagaatataattcaagggaaaaaaaatgataggccacatccggttatgcctctgcgctgatattccattcacacaggcaagcctattccattatttatgctacggccagacagataaattctaatatagaatcacttcgcaaattagttcgtcggttaagaaaagatgacaaaataatgcgaaaataatcacaaaaaaacggcaccccaaggtgccgttagcaattaagtaataacttctatcttagctgtcactatagatattcacgcgatcgcgtaactctttacctggtttaaagtgaggaacgtatttaccttccaattcaactttatcgccagttttggggttacgacccacacgtggagcccggtagtgaagagaaaagctgccgaatccacgaacttcaattcgttcacctgcggccaatgtttctgccatatgatcaagcatttctttcactgcatcttcaacggctttcgctggcatgtgagattgttgctcagtaagtctttcgattaattcagacttggtcataatacctccctaaactaccgtatcaggtaataccaccgttgccgaggtatcacccgatgttattgacttagattattcgcctttagctgctttgaaagcttcagccattgcgttgttagcaaagtttgtatcttcttgtttgttcacagaagcgatagcgtctttttcatcagcttcgtctttcgcacgaacagacaggttaactatgcggtttttgcgatcaacaccaacatatttagcttcaacttcatcgccaacgttcagaacttgagttgcatcttcaatgcggtcacgagaagcttctgatgcacgcaggtaaccttcaacgccgtcagctaattcaactgtagcaccttttgcgtcaactgcagtcactttaccattaacaatcgtacctttcttatttacagacaggtaattgttgaatggatcttctgccagttgcttgatgcccagagagatacgctcacgctctgcatcaacctgcagaactacagcagcaatttcgtcgcctttcttgtattcacgaactgcttcttcgcctgcaacgttccaggagatgtcagacaggtgaaccagaccgtcgatgccgccgtccagaccaatgaagataccgaagtcagtgattgacttgattttaccttcaacgcggtcgtttttgttgtgagtttcagcaaattgctgccaagggttagatttacactgtttcagacccagggagatacgacgacgctcttcatcgatatccagaaccataacttccacaacgtcaccaacgttaacaactttggatgggtggatgtttttgttggtccaatccatttctgaaacgtgtaccagaccttcaacaccttcttcgatttcaacgaagcagccgtagtcagtcaggttagttacgcgtccagtcagtctagtactttctgggtaacgcttagcgattgctacccatggatcttcacccagttgtttcagacccagagacacacgagtacgctcacggtcgaatttcagtactttaactgtgatttcatcgcccacattgacgatttcgcttgggtgtttaacacgtttccaagccatatcagtaatgtgcagcaggccatcaacgccgcccagatcaacgaatgcaccgtagtcagtcaggttcttaacgatacctttaacttccatgccttcttgcagattttccagcagctgatcacgctctgcgctgttttcagattcgataacggcacgacgggaaacaactacgttgttgcgtttctgatccagcttgatgactttgaactcaagctctttgccttcaaggtgagcagtatcacgaactgggcgaacgtcaaccagtgaacctggcaggaatgcacggataccgttcagttctacagtgaagccacctttgactttaccgttgataacaccggtaacagtttcagcttcttcgtatgctttttccagcatcagccatgcttcgtgacgttttgctttttcacgggacaggatagtttcaccgaaaccatcttctaccgcatccagagcaacgtcgatttcgtcgccaacttggatttccagctcgccctgagcatttttgaattgttctacagggattgcagattctgatttcagacctgcatcaaccaatacaacgtctttatcgatagaaacgacgacaccacgaacaatggcacctggacgagtttcgataacctgtaaggattcttcaaagagttgagcaaaagattctgtcatgttaatgatcttcaaggttttaaattaacgtccatctagcatccggccgaatggggttgttttacatacctcgcaactactccctgttacaaggtgctttggtatgccagcatattttactgcccacataccaggattctatatacatcttcttggtgcgctgttgcaagagtacaacatgcgaaaactacaattacgcaggcaatgccaacgcgtttttcgcataagtcagagccttatcaatcacttcttcgatagacatactggtcgaatccaagagtaatgcatcatatgcaggcactaacggcgcaactgcccgattgcggtcacggaaatcccgttcctgtatctcggacaaaaggctgtcaaaagtaacactaaaacccttctcctgcaactgtaacatgcgcctgcgggcgcgttcttccgcactggcatcgagaaaaattttcactggcgcatcagggaataccaccgttcccatatcacgaccatcagcgatcaaccccggtgcgatacgaaaagcccgctgccggcgaagcagggcttcacggacacgaggaaatgttgccgcctgtgaagccgtattgccaacagcttcagtacggatttcattgctgacatcttcgccttccagaatgaccctgagtttgccatttgcaggcataaaacgaacatctagatttgcagccagaggaaccagtgagtcttcggattggatatctacctgatgatgaatggctgccagtgctaatacacgataaatggcacctgaatcaagtaattgccaacccaatgcttcagccagtgcctgacagagtgttcctttgccagcaccacttggcccatcaacggttattactgaggctatcgccaccattattttcctccttttcgcatagcgctttccgcacaacaaacgggtcatctaccgattgcagaaaactgctcaattaatgagcagtaaaatatctcttattatacgcactccgcagatgagtggaataagcacatcatgattacctgacgattttcaccatgagtaagccactgaaatggattcaatccctgattacattatgtattggctcagtttttcaagctgattgaaataatccgggaatgttttggccgtacagcctggatcaagaatcgtcactggtgtatccgaaagcgcaaccagtgagaaacacatcgccattcgatgatcattataagtttcaatttcagcatgattgagcttttgtggcggaacgacacgaatgtaatcatgcccttcttccacctcagccccaatcttgcgtaattcagccgccattgcattgagacgatccgtttcctttacccgccagttataaatattgcggatgaccgtttcaccttgagcaaacagtgctgttgtcgcaatagtcatagcggcatcaggaatagcattcatgtccatatcgacaccaatcaatgtgccacgttcacattccacaaaatcatgaccccagcgaatcgtcgcccccatcctttccagcacatcagcaaattttgtatcgccttgcaggctattcttaccgatacctgtcacgcgaaccgtgccaccttttatcgcagcggcggccagaaaataagaggcagatgaagcatccccttccaccagataatgtcccggcgattggtattgctgctgccccttaacatgaaaaacttgatattggtgattttctaccgtcacgccgaaactttccatcagcgccagagtaatatcaatataaggtttagaaaccaaatcaccttgaatatgaatgtctgtatcattcgccgccagtggtgcagccatcagcaaagctgtcagaaattggctggaaacactgccatcaacgacaactttcccccccgagaatccacctttgatatgcaggggcggataattttcctgttcaagataatcaatttttgctccgccttgacgcaatgcatccaccaagtgacctatcggacgctctttcatccgaggttcccctgtcagcacgacattgttgtctcccagacacagtgccgcagccaacggacgcatggccgtccctgcattgcccaaaaacagctccagcgcaccttttccggtgatagttcccccaatgccatcaatttcacagcaagtacgatcgtctgatagacggtagggaatttcgagtgttgtcaaagcattaagcatatggcggatatcatcactgtccaacaaattggtcaggcaagtagttcccttggcaaaggctgcaagcagcagcgcgcggttggaaacacttttggagccgggcaggttaatagttccattgatacaggaaataggttttaacgtcagggattgcataaacagcgggatctccggtttttaatacgttgtatttgtaattttcgctttaatctattgaaataagtgaggaatattcacatcgggaggtttcattcctcccgataataagcgcattatgcgttacggcgttcaaaatcagccataaactcaaccaatgcctgaacaccttcataaggcatggcgttataaatggacgctcgcgcaccaccagcaactttatgccctttcaaagcgtgtaacccatgtgcataggcttcttccagaaatttaccatccagcattgggttggccagttggaatggtatgttcatgatggaacgattctgtggcgcaacacagttgatatacagattactgttatcaatggtgcgatagaggagctctgctttcgcctgattacgtttgctgatttcctgtaagccaccctgctctttcagccatttgaataccatgccagagagataccaggcaaatgttggtggcgtgttgtacatcgaggctgatttaacctgcacagtataatccagaattgacggagtatgctgatgtgctctacccaataagtcctcacggacaatcaccactgtaattcctgctggcccgatgttcttctgggctcccgcataaatcacaccgtaacgactcacatcaatcggggctgaaagaatagctgaagagtagtcagcaatcacaatcttatcatcgccaaaatccggctcttcaaaaattgcaataccttcaatagtttcgttaggacaataatgcacataggcggcatcactgctcagcgcccattcactcattggctttacgcttctgatgccatcaacttctgtcgtaatatttatgacgtttggtgtgcaatatttttctgcttctttcgctgcacactcagaccaataaccactgacgatataatcggctgtcgttttgtcaccaagtagattctgtggtaaagccgaaaactgaccacgagcaccaccatgacaaaacaaaactttataattctcaggtattgctaataaatcccgaagatctttttctgcttcagccgcaacatccatgaactctttgctacggtggctgatctccataacagatgttcccagaccatgccagttgcaaagctcttgttctgcacggcgtagtacttctgctggcaacatggctggaccagcgctgaaattatatacctgactcattaacttcaccctatcaacggatacaataaaatcggatgtattggttttatcattcccgccctgtcgctgcaatggttattaaaagattgttgcaacctattgtataactggttgatagactgaattattaataatatggatataaaacaccgaaatatataaatcgatgtattatttaaaggtgattttctatttatgaatgtaaaaatagatgtatcaatagttcagcttgtaatgaatgtgatgaacacatccgaaaatataaggaattttaaaataactctcagtaagtaaataatatttttttcaatcactggattattagaaatatgttatggtcagatattgaacttaaatacagaaagacgcattaaaggcgtctttctgcttttctatatctttcatctttcaaattacagcttcattggctacaaattgaaatctattggatataagtcaggaattaatattgagtaaacatttcctgaatttttgctgtatcagaagtttgcgtcagagccagttgcagaagaacacgagctttctgtggattcaaacgctctgatgctacaaaaccatatttgctgtcgttaacttcagcattcttggttgtataaccaaaaggaatacggctggatctgacaacaaccacaccatctttagcggcttgagccaaagtgtcaaaaacggatttatagatattaccgttacctacaccagcgctgacaataccctgatagccattttccacgaatgcttttgctggcaattcggaggcattagagtagttataaacaatacccacttttggcagtttatccagtttgctgacatcaaaagcgaatttatgctctttttctggtgcagtagcagagtagtagctcaccttaccattgtgaacaaaaccttctgctccgctattgatagcctgaaacgcctgaacttcagtggtgctcagtttgccaatatgacgaccgtgaatcacagaatcattcatagaaagcaaaacaccacggtttgcagagtttttatctgccgctacaactacggcattatacaggttcaatgggccatcagcacccagagctgttgatgggcgcattgcaccaaccattacgattggcttctggcactgagtggttaaatcgaggaagtaagcggtttcttccatcgtgtcagtaccgtgagtaaccacgaaaccatcggtcttatcacaatctgcgttgattttttttgccagtgtcagccaaacctgatcattcatgtcttgagagccgatgctgacaacctgctcacctttcaaattagcgatgtttttaatcgcgggtacagcattcagcagtgaatcaataccaactttacccgcagtatagctagattgagttgctgactcgccaccaccggcaattgtgccaccagttgccaaaacagtaatgtttggcagagcaagcgcagaaccactaactaacgtcagaaaaccggctattgctgtttttttagtctttctcatgatttaacctcttgtaaaaaaagtcattttattatgtaaactggaaataaataaactctaattaacaataatttttgggaattgatagagcagacaaaaaaaacgccgtatgatatgcggcctttaacaaaaaattgaagtgaataacgatgacgcaaacctatatccccggcaaagacgccgcgttggaagattccattaaccacttccaatccaagctggcatcttttggttttaatatcgaagaagcctcatggctgaatcccgtacccaatgtctggtcggtacatatccgtgatcgcgactgcccactgtgctttaccaatggcaaaggagccagcaaaaaagcagcattggcctctgcattaggggaatattttgagcgtctgtcgacaaactattttttcgctgatttttaccttgggaataccgttgctaacggggaatttgtccattatccaaacgaaaaatggtttccattgccagaagatgactccctgccagagggcattttagacgagcgccttcaccatttctataaccctgacaacgaactctgtgccagtcaattgattgattttcaatccggcaatgaagaacgcgggatctgtgctctgcctttcactcgccaatccgataatcaaaccgtttatattccgatgaatattatcggcaacctgtatgtctcaaacggcatgtccgcaggcaataccatgaacgaagcccgcgttcaggggttatcagaagtgtttgagcgctatgtaaaaaaccgcattattgcagaatgcatcagcctgcctgaaatcccagaaagcgtaatgaatcgctatcctggcgtagttgaatccgtcaacaaattgcaggcagaaggcttcccactttattgctacgatgcctcactgggtggtcaatttccggtaatttgcgttgtgctgttcaatccgaataatggcacttgctttgcctcttttggcgctcatcctgattttggtgttgcgctggaacgtaccgtaaccgagcttctgcaaggccgcagcttaaaggatctggatgtctttacgccaccaagcttcgatgatgaagaagtgtctgaacataccaatctggaaactcacttcatcgattcaagcggtgcaattagctgggatctgttcaaacaggatgccgactatacatttgctgattggagtttcaaaggcactacagaagaagaatttgccacactgatggggatcttcaatacgctggatgctgaagcttatattgctgattacgaacatctgaacgtttatgcctgccgtattctggtgcctggcatgtcagatatttatccggttgaagatttgcacattgccaataatacaatgggaactcatctgcgtgatactattctggcgttaccaaatagccaatggcaaccagcagaatatcttgctttccttgaacaattggatgacgaagggctggatgatttcacccgtgtccgtgaattactggggatcgccgcaggtaaagacaacggctggagtaacctgcgcattggtgaattgaaatccatgctggcattggctggcaacgatctggaacaagcgctgatctgggttgagtggacacaggacttcaatgcttcggtcttcaccgccgaacgagccaattattatcgctgtttgcaaacactgctgctattgacccaagaagaagatcgtgacccaagccaataccatcaggcttttgtcaaaatgtacggtcaggaaacagtcgatgctgcttccgccgccattgacggcaaaaacggcttctacggcctatggtctgtagattcagagctaaaaacattgccagcacatcaggcattactcaatgcttatgaaaaactgcaaaaagccaaacgcgagttttggtcaaataaataaaccgttacattaaagtttatttattatagaaagtaaaattcaggttaaattaagtttatttaaaaataacaaataaatgacaatttaacctgttattttacgtttttaatattctcaaaaatctttcatataaaatattgttataaattttaaaaaatattttttcattataaatcaatacattaagatataatagtcgcatttagccccccataatcccccagactttctgcgtaatatgatccatatcaaatttaggtcaatgatcgtttgttactatcattacgtgctaaaattaattaaggataaagagagtgttagtatgaaaactgacaacccttttaatttatttccacctgctgtaatggcacaaatcgctgatgatagtggtgtatataaagttaataaacatcccgcagtgacttatttatcggcaatcatggcaggtgtgtttatttccattgcttttgtcttttatattacagctaccacaggaacatcttccattccttatggattagcaaaattaactggcgggatttgcttttctcttggtttaatgctggtggttatatttggtgccgatcttttcacctccacagtattgactatagtttcaaaagccacaggccgtattacctggtcacaaatgctcaaaaattggattaacgtttatatcggtaatctgattggcgcactattttttgtcattttaatgtggcaatcaggccaatatgcagtcgctaatggtttctgggggctgaacgtattacagactgccgatcataaaatgcaccacacctttattgaagcactatgtttaggtattttggccaatctgatggtatgccttgcggtctggatgagctatgccgggcgcagcctgatcgataaattgtttgctttgatcctgccagttgccatgtttgtcgccagtggctttgaacacagtattgccaatatgtttttaattccgttcgggatcattatcaaaaattttgccccaactgaattctgggcaaaagtgggagccactcccgaacaatttcctcaactcactgtttcacactttattactgataatcttatccctgtaacgataggtaatattattggcggtgcgatattggttgggttgatttattggttcatgtatttacggggcggccaaaaatattaattcgcctccacgtcaggtctcttaaaagttccactgttaaaaggtagaaatatcatgtccgagttaaatgaaaaattctctgtagcatggcaaggctttaacgagggtagctggcaaaatgaagttaacgttcgtgacttcatccagcagaactatgctccgtatgaaggtgatgaaacattccttgcaggcgccacaaaagcgactgatattttgtgggaaaaagtcatggaaggtatcaaaatcgaaaaccgtactcatgcgccggttgattttgacactgatgttgcgtctacgattatttctcatgatgcgggttatattgccaaagacctagaacaaatcgtaggcctgcaaaccgaagcgccactgaaacgtgccattattccatttggtggaatcaaaatggttgagagttcctgtaaagcttacaaccgtgaactagacccaaaactgaaacaaatttttactgactatcgcaaaacccacaatcagggagtattcgatgtttatacacctgatatcctgaaatgccgtaaatccggtgtactaacaggtttgcctgatgcctatggccgtggccgcatcatcggtgactaccgccgcgttgctctgtacggtatcgatttcctgcgtgatgaaaaatatgctcaattcacatcattacaggaaaaactggaaaacggtgaagatctggaagctactatccgtctgcgtgaagaaattgctgaacagcaccgcgctcttagtcagattaaagaaatggcagctaaatatggctgtgatatttcctatccggcgatcacagcgaaagaagccgtgcaatggacttacttcgcttatttggcagcggttaaatcgcaaaatggtgcagcgatgtctttcggtcgtgtgtccagcttcctggatatctacatcgaacgcgatctgcaagcaggcagactgacagaacaagaagctcaagaactgattgaccatctggtcatgaaactgcgcatggttcgtttcttgcgtactccagaatacgacgagttattttctggcgatcccatctgggcaacagaatcactggcaggcatgagcttggacggccgtactctcgttaccaaaaacagtttccgtttcctaaacacactttatactatggggccatccccagagcctaacatgaccatcctgtggtctgaaaaactaccaatcaacttcaaaaaattcgcagcgaaagtgtctatcgatacctcatccctgcaatatgaaaacgatgatctgatgcgccctgatttcaacagcgatgactatgctatcgcatgttgtgtcagcccaatgattgttggtaagcaaatgcaattcttcggcgcacgtgccaatctggcaaaaaccatgctgtatgcaatcaacggcggtgtggatgaaaaaatgaaaatacaggttggcccgaaagaagagccaatgagagacgaagtgctggattatgacaaagtcatggctcgcatggatcatttcatggattggctggcaaaacagtatgtcactgctttaaatatcattcactatatgcatgacagatacagctatgaagcagcactgatggcgctgcatgaccgtgatgtttaccgtaccatggcatgtggtatcgcgggtctttccgtagcggccgactcactgtctgcaatcaagtatgcgaaagtttctccaatccgtgatgaagatggtttggcaactgatttcaatattgagggcgaatatccacaattcggaaataatgatccgcgtgtcgatgatatcgcctgtgatctggttgaacgctttatgaagaaaattcaaaagctacaaacctatcgcaacgcagtaccaacccagtctgtactgaccattacttctaacgtggtttatggcaagaaaaccggtaacactcctgatggacgtcgtgctggtgcaccattcggccctggagctaacccaatgcacgggcgtgatcaaaaaggtgcggttgcctcactgacttctgttgccaaactgccatttgcctatgcgaaagatggggtttcctatactttctctatcgtgcctaatgcactgggtaaagacgatgaggtacgcaaggcgaatctggctggtctgatggatggttatttccatcacgaagcggatattgaaggaggccagcacctgaacgtcaacgtaatgaaccgtgaaatgctactagatgcaatggaaaatccggagaaatatcctcaattgactattcgtgtatctggttacgccgtgcggttcaattcgctgactaaagaacaacagcgagatgtcatcactcgtacatttacccagacgatatgattaagaaaaatagcattgtccaaaagtgtcattattctctattgaaataaaatgacatagactaaaggccccttcacaattggggcctttattatcctgtcagtttttggagaaacgctttcatgtctgtacttggtcacatccactcttttgaatcttgcggaaccgttgatggcccaggtatccgttttatcgtgtttttccagggctgcctgatgcgttgcctttattgccataaccgcgacacgtggaatacccacggtggtacaacagtcactgttgaagagcttataaaagaagcgacaacttaccgtcattttatgaatgcctctggtgggggcgttaccgcttctggtggagaagccatccttcaggctgaatttgtccgcgactggttcagagcctgtcatgcagaaaatattcacacctgcttagataccaatggctttgttcgtcgttatgatctcatcattgacgaactgctggacgatactgatctggttatgttggatttaaaacagcttgatgatgaaattcaccaaaaattaatcggtgtttccaatcatcgcacactcgaatttgcccactatctggcaaaactcaatcaaaagacctggattcgctatgtcgtggttccggggtggtcagacgatgataaatctatccatatgcttggtgaatttactaaggatatgaagaacattgaaaaaattgaattattaccttatcacgaacttggcaaacataaatggattgctatgggagaagagtataaattggaaggagtaaagcctccttcaaaagaaacaatggaacgagtaaaagaaatcttagttagttatggacaccatgtcatctattaagctcccttcctatttttttcatttaatataacctgactaaaaatttaatttcagtcaggtttttctaaaaaatcttggattcacatattaagcgcaacaccgtaatggacgaagtaaatgagtgggtattcctttaaataactcattcggtgttttgtcatctcgtgttttacggggacgattatttaatcggtttgccacaaggttaatctcccgctctgacaccttattaaaatcagttccttttgggaagtaatctctgattaatccattcgtgttctcatttatccctctttcccagggggaatacgggtgagcaaaataaatttttgtctctaaatttttactgatcagttcgtgttcggcaaactcgaggccgttatcaaaggtcattgttttaattttatgttttatcagtgataaatgtcttgttgccgcttttgcgaccccttctgctgttttattttcaagtttaattatgatagtaaataacgattttcgttcaattaatgtcaataatgcacttttatgatctttacccacgagagtatctccttcccaatcaccaatacgctgctttttatcaacaagtttggggcgcttatcaatactgactctgtttttaattttgcctctgcgcttataacttccatagcgtttacgatacggttttttcgcaatcctaagatgtagccataaattatcaccattaagtttatccttataaatcaatcgataaactgttttatgatgcaaagatattatattttcccttttgagataaccgactgtttgttcaggatttaaatcttgctaaattaactgtttgatccacatttctatctctggtttcacttttattgcttttgtagcacactgtcggcgcgctacggccttaagctgagtttgttcaggcgtatatttctttgcctcccgatttcatctcaattcccggctaatcgttgatgggtttcgattgagtgactttgaaatctcccgttgtgaaaaaccggcttctttcaggctgaaaatctgatatctttctgtttcggtcagttgtttataggccatcgcgcattttcctttggcgagaaagatgcctactatagcaactgactgcctttcttagaaattgcacttattatgcgaatccaagttatcttaatacattatctcctgcagagatgttttaccgtttggttgcataaataatagacagaactaccttcattcaaactttctttattaatgcgacagaaccagcgcagttcctgttcccaagcgttagtaggtaagtgcattgaacacctctccctcttttcaggaaaaaatgtcaggggttatcatgccacaatggggcgtacggctgtaatacgtggcagtgctaatgcgctgatcctgatattatttattttttacccatgcattgtttatattcaatatccatacatcttgcatatagccaagatttgaaaatggatggccggcatatgttttgagcctgtatgttgcattgaggatttgggtatggatcattttgatataagctttcagcgaagctaatattagctaacgcaaaagtcgatatacaaagcaatatgatataagataatcttttcatttttaaatctcccacatttaatacgcttaattcattaatatgtgaatacaagaaatattttttagggtgtgttaacactaaattatgagataaataaatacgatagttagaaattccttaaacattaagtccagtttttcgacgtgtgtgaaaatcctcctgaatccttttagtatgtgaaaaagacgttcgacttcattacggcgtttatagagctacctatcatagccccatgaggcataaaggggaataaataaatctttatgaaaaataagaaactatcccaatgggattttatggttctgtcgcattaagcggtcatcaggtaagctcccctgtttttgagcgagtccagagcgatgccccttatccgaaatgtagtggtcaagagatatcggacatctttttagcctcttcccaacctctttcgtattcaaccggtgacatcccatcccgccattaaagcgatggggacgttggtgattgtaatagctacccagatattagggaattatcatcgcagttgcctcttcgactcatgctttggataaccttatttcgccagagtaaccggtgaaactttttgctgctgtattgacttccttgatctgagtgaaaaatcagtcggccttcaatatgacgcgtttccagcgcattgttcagtgcccgacataccaactcagcatccgcattcctaccacgcgacgggaaaataaatcgatcaccacggcaagatagcgccagcactcttttgtgcagatggatgtaatatcaccggatcactggatgttcgggcactccggtgtaaaatgctgccgcaaaagatggggagaagtggcgtgttcttcgcctgccggacggtaacgatgagcgccctgctgacaactttgcagaccgcattcctgcattaaccgtctggccttccagcgcccaacgggttggccttcattcgtgagccaatggctcaacgtgcgactgcctagcctcagagcggctttactaccatcactggcgctaccggaatgaggatctcgaagagaggagcacgtttggtgatagcgaaatatgctcaaaaaaacaccctaaattaaatgtacaatgttttcccatatccaaaccaatcccttatttgtttaaaaaacatacttagcgtacgttttcgtacggttgggcttcataccccataaagggaaggcaaaaatgttggctttaggcgctgcgatgtgtaagttaattcatttgtgctatggattattaaatacgcagcaatcatatgatgaaaactatgctattagaacttaaccatcaagacagtaacttattagtcgaatctgccctttaaatatgtgcatagtttaatcatttataacaaaaagagaaattgatatgtcagaaacaaaaaattatactgacttggtgcgaaaggaatttaattaagttgctcctatttactggaataataatgattatttaaaaaagttaattgagcataaagatttttcttttttatttcttattcattctaaattagctttaaagggttggttttttgataaatttcagctcaattcaactgtaatattagcagtaactttaacaatagcatgcttcttacagtaaatgtgactgtcggtctatttttcttggtagtcttttcattatcgttatttttatatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatatttttaatctgatcattttaaaaaaatacttgatttcaattggctggattaagtgttttattaatcaatagaaagaaggttttttattggggagtaataacgatcatatttattaattatttttaataaagggaaaagctttttacccatattaatattatttatggtaattattttaatttaagtgattgatattttttgtcagattggcggcttaaaaagggtacaggattaatattaagaggcgttatcttttattgcgaatagatttcaagttgtagcgcgatagcaagtgagtggatccccaggcatatagataacaatgtgactagggagtagtaaactcagccgcaaaagcagaaatttgaaagcacatacctgtcgattgggataggttttaacgcgttccattgcttgatgcttgcaggtatcgttgtgcaaaaaacagggcgctgacgtttctggcttcgttgaaatcgggatgttccagcaaagacatcatatctgcgattggccagcgaacctgtaccagcggttctggctcatctccttccaaacattcgggataaagatcttgagcaatgacaatattcatcctgctggaaaaataggagggagccattgtcagttttgtcagcagttccagtttggctgccccgaatcccacttcttccttcagttcacgattggcagcttcaagggtgctctctcccgcatcaatagcaccctttggaaaacccaattcgtattgttcaatgccaacggcatactcacggataaggagtaactcatcgccgatcacgggaatgatcagtactgcttcacgattggagggtttcatgcgttcataaactcgctttacaccattgctgaactcaagattaacagactgaatattgaataaacgggaatgggcaacgtcatttatattcaatattttaggtatcttctgatcaatcatgcttgcccctgatggttgccatacactggctcattgaaaaatgatgcatccaatcaccgaaaaattcttggtaaattcaatttttgtgatgaaattggatacgcatccaaactttgctttaatatggccgattatgccagtaaatgatagcgattatcgcttgtatgtatttttgttgctatcttacggctgcacaaaaggctttattttgcgaaatggtgtaataaaatttatttaaccttttgttaataacattaaaaatagaaggtaagaatagaaatagcctgaatctgcgtatttttgtcaggttgttattctgccagtctctttattgctgtcatgggcgtggataagaaatgagttcactagtcattatattggctatttttatcactagcatgattataatggtttcctttctgactttcagatggaagcggcctgataacgcgcgttatctaccgtcaatcgccaaaacaggccatcgtaagctgaatgctgatgaatatcaggcaattgattcttatttgcaaaatgctctgtccctgatgcagccagataggagccacagatcaggccaaccagcactgtctgtcaaaaatgatacggtttataccatcaatcacaccatcaaccgcttttctgtcgctacggatgaatcgcagtattggcgctattatgttgatgaaatggagatacatcttcctgcgttacttgagtcattcattaagcagcagaatacgattgagattgttcaaaccacattcatgcctcttgttattgccgtgaatggccacttcctgaaagattatcagcaagatctgtccatcgcgcgaatcgtgaaacaaacggcacaggcttcaatccaaaaaaacggcaattccattgccaattttttgtatatccgcaaggaaacgccggaagagaatcgtctgcgtcgttcaacaggcattctggaaggcattctcatgtgtattggcttgtcgctctggtttttggctcttttcatgccaacgcccatattaccgtggctaatgttggccgctgttctgtttctgattaccagcttctggctgactttccggtcaccttctccgcgtaacattttgaatattagctgctttaatggtattccgaaacgttggggtatattcagtgaatctgaaccggaacagcggaggaatatctctctggggggtattgatcttatctatccctcacattgggagccgtacgtcgttcgtgagcttgaccaaaatactgatgttgatatatataccaattgccatgtcgttcagcaggggcgctacctctcattgcatgaggaagaaaaacactatccttatcagcgctatagaaaaaacctgatactggtggttttttccatttgtgctatgttggtactttatttttaccagcccgtgagcttatctatgcggctcagttttgcatggctgtatgggagtaatactcaggtcatcaccagcgtcactgaactgcaaaatatgcctctgaaggaaggcgatgtactgcgagttaaaggcatagggatgtgctacataccacccagactgaatgataatcccggtggaatcaaacatatatttactgcgtttgactgcactggcatctactggaataacgatagcccattgcccattccggaatcagatattatcgaaaatgcatcaacattgattacaacggtcaatgagcaattacacccgattgaacgtagccggaaaaccaactctgacctgaatgaagccattgcgaaatcgggtatgacattactcgacaatttttcgcaagtcatcttgaagacgcataatttgtgcatggacgagattgactgtattcgtctgaaaagcgcactggtcaatctgagcaatgctgaggattggaatgatctattgaaacaggctgaaagagggaaactgaatggaaccaaagtattattacgttcagtaagcgcagatgcactggaaaagttaattgataccaccacagcatcatttatttatcgggaaattgataaaataagcatactgctgaacagcccatcgccggggggcgtcctgctgatcagcgaggaagggaataaattggttgaattgccttatttaccatttcttacctatgaatacagcgcactggatcagtggagggaattacagcggttagctgaaatactgttgagtgctccatttgaagctgtcggaattgtgacgaaattgtccgaagacgcaaatgagactcgccgtatcaccttgcatagtgaacccgactccgtgactcttattcgttatctgggaagctgcttctttctggcaatactcatggcgatattgagcatcaatgccattctgataataagcaaaaggcagaaaaataaggtgcggctccagcgtataggcgagtactacgacaattgtttcaactcgaaacagccgccgatggattagcgatgagtctgcgggctgtgttaccctcaatccgttttttgccagcttcgattagacatttgggagaaacaaccatgccgaattcagacacggatcagactatgcgcctcgataaatggctctgggctgcccgtttttacaaaacccgctccatcgcgcgtgaaatgattgatgggggaaaagttcattataatgggcagcggagtaaaccgagtaaactggttgagttgaatgcagaaattaaactgcgtcagggaaatgaagagaaaatagtgactgttttagcattgaacagtcacagacgcagcgccactgaagcccagcaactttatcaggaaacggaaaaaagcattatcaatcgggaaaaaacggcattggcccgtaaaatgaatgtgctcacgatgccgcatcccgatcgccgcccagataagaaagagcggcgtacactgattaaatttaagaacacgaaattaaacgagccggaataaccgtctcagtgagatgagagagatttatgaccaagcatgatcaattacaccgctttttgttcgaaagccattctgtccggggagaactcgtttccgtcagtgaaacgtaccagcggatgatggaaaatcaccattaccctttgcccgtacagcagttattaggtgaattgttggtcgcaaccagcctgttgactgccacattgaaattcaacggagatataaccgtacagattcaaggtgatgggccagtcagactggcggtcattaatggtaataatcaacagcagatgcgtggcactgcccgtattgatggtgatgtggatgctgcgagcagcctgcgggatatggtcggtaatggttatatggttattactgttacgccaacagaaggtgaacgttatcagggcgttgtcgcgctggaaggggagacgctggcagaatgtctggatgcgtacttcaagcagtcggaacaattgccaaccagactgtttatccgtacgggaatactggatggaaaaatggcggcgggtggcatgttattacagatcctgcccggcgcacaggaaggcagtgaagacctgcttgatcatctggtacaactcactgcgaccatcaagggagaagagctgtttacgctggatgtgaaagaaattttgcatcgtctttatcatgaagaagatgtgacgctgtatgagccgcaacaggttgaattccgctgtacctgttctcaccaacgctgtgctgatacgctggtgacgctgccggatgctgatcttcaggagattttgctcaaagatggcaaaatcgatatggaatgtgaattctgtggtatgcactatattttcaatgataaagatatcagcgaaataaagattgtgaaaaaagaactgcttcactgatgcgattaattattttttcagggcgtaatatacgcccttttttatgtgttcattaatcctttcattccgtgtcctgcgtctcatataaacctaaaaaaagtaatgcaatttcaattttttgataacaatcgctgttaattagtcataattatttattattccccgccgagaaaagtgtaactgatcaggagcaacacatgagcgttaaaggcattactgcgcaggaacttgcggtttatggtatttgtgatgttagcgagattgtttataacccaagttatgaattgttattctctgaagaaactcagccctcactgcaagggtatgagcgtggcacactgacccatcttggtgcggttgcggtagatacagggattttcacggggcgttctcccaaagataaatatattgtccgcgacgatgtgacgtgcgataccgtatggtgggctgatcagggaaaaggtaaaaacgataacaaaccgctcagtcaggaaacctggtctcagctcaagggattggttacgcagcagctttcaggcaaacgtttgtttgtcgtagatgcattttgcggcgcaaatgcggatacccgcctgaaagtgcgttttatcaccgaagtggcgtggcaggctcattttgtcaaaaacatgtttattcgcccatcggatgaagaattagttaacttcacgcctgattttattgtgatgaacggggcgaaatgtaccaacccgcagtggaaggaacaagagctgaattctgagaactttgttgcctttaacctgacagaacgtatgcagttgattggtggtacttggtacggcggcgaaatgaaaaaaggaatgttctcaataatgaactacctgctgccattgaaaggtattgcatccatgcactgctctgccaacgtgggtggagaaggcgatgttgccattttcttcggcttgtctggtacaggtaaaaccacgctttccaccgatccgaaacgcaagctgattggtgatgatgagcacggctgggatgatgacggcgtgtttaacttcgaaggtggctgctacgcgaaaaccattaacctctccaaagaagcagagccggatatttatcacgcgatctgccgtgatgctctgctggaaaacgttaccgtgctggcggatggcacagtcgatttcaatgacggttctaaaaccgaaaatacccgcgtttcttatcctatctaccatatcgaaaacatcgttaagccagtatcgaaagccggacatgccactaaagtgattttcttgaccgctgacgctttcggtgtattgcctccggtttcctgtctgacgccagaacagacccagtatcacttcctgtctggttttacggcgaagctggcgggaactgaacgtggtgtgacagaacctacgccaacgttctctgcctgctttggtgcggcattcctgtcactgcatccgactcagtacgcagaagtgctggttaagcggatgcaggcatcaggtgcgaaagcttatctggtcaatactggctggaatggcacaggtaaacgcatctctatcaaagatacccgtgcgattatagacgcgatcctgaatggtgatattgaagatgcagataccattgagctgccgatctttgacttagctgtaccgacagcattgccaggcgtggatacaggcattcttgatccacgtaacacctatgcggataaatctgaatgggatgttaaggctaaagatctggcacagcgttttgtcgataactttgacaaatatactgatacagccgcaggtgctgcattggtgaaagcagggcctaatctgtaatagctgccgtgttaaattcacagcaaaccacgtaagaccctatctggctggatagggttttttcattcatcgaacattaatcagcaatcagttaggtggcaggtcgaacagcaggatttcgctctcttggctggcaattaattgaagatgagattcatcccagatagcgatgccatcgctggtggtcgcttgaacgccattgatagtcacttcgccacgaacaacctgaatccagatttttcgcgatttttctatatcatactcgtctgtttcgccgtttttcagtgcccaacgccataaaatcatattctgaaatacttttaacgagtcatcgcgagtatcgggcgaaaggattaactggcgacctttggcagaatcaaagcagcgttgctcgtagcgcggtggcaggtcatttttttccggcatgatccagatttggtacaggtgaagtttgctactatcatgcggattatactcagagtgacggataccggttcctgcgctcataatctggaactctccggcggaaatttgcccctgatttcccatactgtcccgatgctcgactgtaccggaaagcacataggtcaggatttccatattcttgtgaggatgcatgccaaacccttgtccggcatcaattacatcttcgttaatcaccctaagggcagagaatcccatgaaattggcgtcataatagtcagcaaatgaaaacgtatgccagctgtccaaccagccgtgattggcgtgacctctttctgaagctttacgtaagtagatcattttcaaaatccctcaatgttttttgtagtctaattgaaggcttgaaatataaaagattgtaaatttaatcttaaaattcaaaatttttgaatagtagctgtagctaagttgagttaagtataaaaaaaagccaacattcaagttggctataaaaataaacactggaagcaatgtgagcaatgtcgtactttcatatgaccctgaaggtggtgcactgaaagtaatagtaatgataatcgttcttattatcgtttgtaaagtgtttttttaaccaaatttagaggtatagctaaaaagtcgatctttacacgggatcgccggtaaagtgtactgattatgaaaacaacatcgtcctgacaactgagccagggtaacaaaccagtgccgtaaaataccctgcatcagataactgccagagaggtcacatccaactattgcggaaatggtaaccatctataagcaattgtggaattaatgactgatttattggagaaaaggccatgaatatcgtaggacgttttattaacggcaatgttactgatatccattcatgcttacaggatatttattcacgcaacgctggccatccgctagccccttgacgtatctattgcaatttttttaatatgttaacgtaatttttatttaaattacgtaagaaaccacattatttaaacataactaagatggaactctgtatgtcatacatgatatatctaacattaaatggtaagaagcagggcttaatatcagcagggtgttcaacgcttgattctataggaaatcggtatcaaaaagggcacgaagatcaaatacaggtactcagcctgaatcatgcaatttcacgccagcagaacgtgagtcaccagccaatacagttcatcaaaccaattgacaagtcatcaccactactggcaatggcaatagactccaatgaatcactgaatggcggttttattttttatagaacaagccaaacagggcaattagaattattctacgaagtaaaaattacggaagccactatcacagatatctcctgtgtatacccacattctataaatgatcacgatatgatgccatatgaaaaagttacattaaactataaatctatatcatggaatcatataacggcaggtacatctgcctatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatatggtgttattggtgcatcaggtattcgggtattgattgattctaaagttgattatagcaaggcacagaacctgatcctgacctccgttattttgattattggtgtcagtggggcgaaaatccagattggtacagcagaattgaaaggtatggcactggcgacggtagtaggtatcggtttgagcatgattttcaaattgatcagtgttatccgcccggaggagccttatattacttcttctgtagaatcgattgacaatgataaaaaacgtgaagctgtagagtaagtaagattaattcaatttataaggaagggttttaaagaacaaacccttctttttttgactcataatgaaagtctactatttaatattctttcataacgttatttttattaattcattctatatcttggttttttctttaatatttcactgagaggtcaggaagatgatatagagtgattttaattgatacgtcaatcgcctaaataaattttaatcaacgttaatgtctatttattgattctttttagttaagattatcgctgattataactattaaaatcagggtattaattattaataaagatcagtagtctgtatcctgatgaatccattctatgggcagttgataaagacggcttgatgatggaaaaataggctttgatgctaatctggatgtcaattctaattctaatcagaaaaacaacacgttgttatctcctgtattataaaccttatctttcatgaaaaggcaggcgctaacaatcaaggcctgttttaaacagcgtatttatttcatttatagttactttctgtggtagacttagtgctgttcgttatccattctgtttgaggtgcttctgaatacaccgtcgcagctttcattgcccctatatttgcccgatgatgaaatatttgccagtttctttgcaggtgagaatacttccttattagctgcaataaaactggccattagtcagtcacacggcagttatatctatttttggtcccgcgatggcgggggcaagagccatttgcttcatgcatcttgtgccgaattatcccaacagggagaggcggtgggatatgtaccactggataaacgtgcctattttgttcctgaagtccttgatggcatggaacatttatcattagtgtgtattgataatattgaatgtattgcaggcgatcaagaatgggaaatggctatcttcaatctttataaccggattgtagagattggccgcacctgcttattgatcaccggggatcgtcctccacggcaaattaatctgacattgccggatctggcttctcgtctggattgggggcagatttacaaattgcagccactgtctgatgatgaaaagattcaggcattgcaattgagggcgaaattacggggatttgaattacccgaagatgtagggcgttttgtgttgaaacgactcgatagggaaatgcaaacactgtttagaacgttagatgagcttgaccgtgcttctattgtggcgcagcgcaagctgacgataccatttgtgaaagatattcttgatctctgagcgaaccagtcaggaagggaacaggaaaaaagtgatagtgaatatgtccctatcacttttttgtttgtatgatttttctggaaagtgaggtgtcagccaagaatctccttaacttgttctggtgggcgacctagacgagctttatcaccgacaacaacaatcggacgctctatcaatatagggtatttttccatcgcttggagtaatgcggcttgggataatgtgtcatcaccaagattgagatccttataaagttcttctttggttcgcattaactgacgggcatctttgaaacccagttgcttcagtaaaacggtaagctgctctaccgttggtggggtgtcgagatagtgaatgatttctggtgcaataccgagatcttcaaccagcttgagtgtttcgcggctctttgaacagcgaggattatgataaaaaataacttgtggcatgtaaaaagtcctcatttgtcatattggatatgacgttgttgcagttggcgcaattgatcaatacgggcatcataacgagcctgatcgtcactatttaatgttaccaaggcactggcttggctgagatagtttatagccatgtcaaatttgccttgcaatgccatagtctcagcgtaggaagccagctctttatcacgttttttctgttttttggctaattctgtcattagtgaccagccagtgggatcattaggatcgttgaaggtataacgaaatagcagttgtgatgcttgcggatagtgtttggcctgaatataggcattggcaagattgatttgtagtaccgggttattttgatgtttctggagagcttgctgtaaacgggtaatcgcttgctcatactgtttttgctcaatatcgatatccgtcatagcatcgataaaccagatgttatcaggctgcttatccagtaatggggacaatactgttttggcttcagcatacttttgagcctgagacagaaggagaacccgcccataagcagcggcgagctgttctttagcggttccttgactgtaattattcagaatttgttcaatgtaattgagctgatctgtagcgctgattatcaggatgcgaacacgggcaaacagaaaattttgagattctgattctggaacggtttttttcggatactgatttgccctgttacgagcatcggataaacggctatcgggtagtggatgggttaataacatttctggcggtttagagctatatcgcgtctgatcaaccagaatctgcatgaaattaggcataccatgagggttaaaacctgaattgttgagaatctgcataccaatgcgatcagcttcttgttcatttgactgggtaaaactgataataccttgctgaaaaccacccagtgtgccgctgagtgtcgccattcctgcttgtggattggccatcatcaacagtatagatcctaatactcctgcccatgcgaatggcgttttgcgctgtgtatcctccataaaacgagccaagtggcgttgtgttacatgggagatttcatgagctatgacagaagccagctcactttcattgcggctatagcggaatagaccggaatgtagcactacgttaccaccgaaaacagcatacgcgttaatagcggggttattgatcagataaaattgaaaaggcgttttcactgaatcggcatggttaactaatttatggcctaattgattaatgtattgtttaagcagagggtcatcaattagcggcgctccagcacgtatctggcgtataaaaaaatcccccatttctatttcttggttgatactgagggtcgcccccgcacttgttccgatatcgggtagtgaattttcggaacttacagataaagcgggtgaatttccaaataataataggctaatcaatgtcactatcagggatttcttaggtgtttttatcataaaatgtttctcgtaaaaacaatgtgtcccagttagttattaacttatgaatgtgtgtatgatagcaaatcataacttaaaatcagtccatcgtaataaatttagtaaaaatcataaaagataaacgccagatagttgcagcatgacagagtgtgttgccacgtaattatggtttagcgggtaatctatagcatgaaatgagaatcaacagagcatcaattatattcgtgaaaaagccacggagatggttattctgactatttgtacttatgcgatatttgttggtttgtctgtacttatcccttatatcggcacggtgattgtcacaattcctgtcattatttttggcggatttctggggcgtctttttcaccattccactggcaactttgatcaaggcggttattcgtgtttggcctgaagaaaaactcgtcggatcagaataataattgtattgacatttcaggcacgacgttaatgtagatagcgaaattccccctgtttgacagggggattggtcgatgccggattatgatgaatgttgtttcaggtagtccagtacgatttggtgatggttactggttttgaatttatcaaaaacgtgttcaatatcaccttttgggtcaactaagaaactaatacgatggatgccctcataggttttccccataaactgttttactccccaaacaccaaattgctcggcaacctgatggtcaatatcggcaagaagtgtgaaattcagcatctctttttttacaaagcgggataacttttcgggtgtatctgtactgatgcccaacacttcaacaccgatttcttttagttcattcatcttgtcacgtaagccacaagcctgaacagtgcagcctggcgtcattgctttgggataaaaataaactaaaacacgctgacctttgaaatcagatacgccaacggttttgccatcttggtcaggaagactgaattttggggccttatcaccggctttcaatcggctcatcacgtattctccgtttaatcgtttttatttaaatgatccagtacgctaatactgccttgtgcatttaattctgtacataggcgataaaaggattctttgaacatgaggccattatcatccagtgggttatggcctgtaatgtggatttgcagacgggcgggcatattttccacagcgggatgagtttttgatgccagttcagcaatattgaaattctgggtcgtgaacagattggtaaaacgttcaacaatacccggtgaatcatccacatccactctgacggaaattgtcgaaggaaattttgtctggacaccgcaccgggttcgtttcatcacaataagcaattcgagttcagcccctttctgtggcagagtggattcgatcagggtaatggcgttccagctaccggatagcagcatgataaaggtaaactcttcgccaaacattgccagacggctgtcttcaatattacaaccacatgcgctggcaaggcgggtaatggtattgacgatgccggggcgatctgcaccaagggcggtgatcactaaaaaatgctgttctgattttggcaaagcgattttcctttctacggtagatgtttgctgtgtgtcgtcattaaacataaaaaatgatcaggagaaggtcaatcgtatttgtgaagggaagtgcgattataatctctgtttaatcgactacacttgatattaacaaaattcattgaaatcgtgcgcttaaagagttttcttctgtatgacaagaaagtaccatgaacttctcatccgcagtttaaggtttagttaagggggaaatggcaatggtgagtggtaactctggttttacgggcagtatggttgcaatggtaacgccaatgaattcaaacggtcagattgataaaaccagtttgaaaaaattaattgattatcatgtcgccagtggtacatcttcaattatttctgttgggacaacgggtgaatgcgcaacactcaaccaagatgagcatgtggatgttgtactgacaacactggaattggctgatggccgcattccggtgattgccggaacaggggcaaatgcgacggcagaagccatttcgctgactcgtcgttttgaaaatacgggtattgctggttgcctgtctgtgacaccttattataatagaccatcacaggaaggtttatatcagcattataaagcgatagctgacaatactgacttaccgcaaattctgtataatgtaccctctcggaccgcatgtgatttactgccatcgactgttgcccgtctggcaaaactggaaaatattgttgcgattaaggaagcgactgggaacttaggtcgtgtcagtcagatccaagaattggttaatgatgaaaatttcattttgctgagtggtgatgatgcaagttttctcgattttgtgcagcttggtggaaaaggggttatttctgtgacagcgaatgtagcggctgcggagatggcacaaatatacgaactggctcagaagggtgaatttgtgaaggcgcgtagcctgaacaaccgactgatggaattgcatcatcaattatttgttgaacctagcccgacgccagccaagtgggcctgtcgtaaactggggttgattgccgatgacacgctgcgcctgccaatgattccgttgacgcaggcgggacaagtttcggtcaataatgccttgaaattggctggattactgtaaaaattagggaattttaatggcaacattattgcaaaaatcgaaggtcatgaaggttgctggcctgtcattagttgttttgctggcagcctgttctaaagatcagcactataaacgtcaggtgaatggggatgagtcctatcttgagacgccaccgctgaaagcattgaacgttccagcaggaatgatattgccgccgcaaaatagtgaatataatatttcatcagcgaccgaaaaaggggtggtgggtaaatcccttgatattcgtccgccagtacaggctatgcagttattgacgggttcccacatgggaaataatgtacgagccggtaagttgttgattgaaaataccccagaacacagcaacctgtggtcacaagtggttagtctattggcgaagaagaattaccaaattagcgaaaaagatgataccaggcaaactctggtcactgattggatctcatggccgcgggcagatgaaaatattccttatcgtggacgttaccgtattgaagtgtctccacagggttcccaaatcgcgctgtctgttacaaatgaaagtttggaacatgatggaaaagttgtctctgatccggcaataatccaagattatgatttaatcatgcttaacgagctgtctgatggtttaaatcagcagcaggagttagcaagtttgaacagcacgaagaatacaggggcgttaatagtaaacagtggcagcgataatacagctttgccccaaatcattgtccgtgcgccttacactgtggtctggaaccgattaccgcatacactggaaagtataggcatgcgtgtcactgatcgtacgcgtgcgacgggaatgatagaggtgacttataaagagctgagttcttcaggctggaaagaactgggcgtcgaggctccttccatcagcgaaggaaattacaagttacaggtgggcgacttggataaccgaagcagcctgcaatttatcaaagagaaaggccagccgttaactcaggctgaaaatgatcaaatgatggctgtatttaaggccgcattcagcagagctacagacaagtaatacataaaggggccaaggcccctttatagtttgggtaaaattttttcgtttaatttttttgtttaaagatgtcacatctctggagtgtaagatgcagaaaaaagctgagttgtatcgtgggaaagcaaaaacagtgtattccactgacaatcctgacctgcttgtgctggaattccgtaatgatacatcagccttggatggtgaacgcatcgaacagtttgatcgcaagggtatggtgaataataaattcaatcatttcattatgaacaaactggaagaggcgggtattccgacgcaaatggaacggctgctgtcagacaacgaatgcctggtgaaaaagctggatatggtgccggttgagtgtgttatccgcaaccgtgctgcgggttctcttgtgaagcgccttggtgtggaagaaggaatggtattgaatccccccctgtttgatctgtttttgaaaaatgatgccaagcatgacccgatggtcaatgagtcctactgtgaaacattcggttgggttagcaaggtgcatctggccgagatgaaacaactgagttacaaggctaacgaagtattgagcaaactgttcaatgatgctggcttgattctggtggatttcaaattagagtttggtttgttcaacggcaacgttgtattgggggatgagttttctccggacggtagtcgcctgtgggatcagcagactttggataaaatggataaagaccgtttccgccagagtcttggtggcttgattgaagcgtatgaagaagtagcacgccgaatcggggtgattttggactaacaacgcaaacgattacttaagccgataatcagagatatcctacactaaagtcgtggggtatctttgatcgcgatgacggggtatttatttgataaatatgaaaaagagatgtggtaataggaaatattcaggatagccaatagcttgattgactacccagaccatgattcttatttattacagcacattaaaacagatattttgtctgtttttcccaaccgtttcgttccatacagctgctatataattgatgtctggagcgttcgttaacatccataacataactttcggtcgtagggacactctgatcgaaataacagtctttgtcagatttatcagctttgtcagatttacaacaggcaggacagtaatgttttacagttttgattgaagaccgttgggcaacttcgtttctcacagggaactgctggaatgcttctatattgcactctgaattcgcttcattaaaaggcgtgtaatgacttcctaccggcacccattgagtggtgcaaccagttaatgtcacactgaacatgattgagaagagtatttttttcatatctttcatacgagtgcatcccgtttgcaaggcttcccttacaatctttccgcattttccctgttaaaagtattaacgtgtgtttgtgtagtatggttaatgtagcttgatgttgaactaacaaatatatcgtcacaatctatgatatttcagacacttagtaagtgaattaatttgattgttactaaatattattattgataatcgttattatgtaaaccaataattctaaatgccagcaattctatgatcaggattgtagacattgggtaaatggaaaagattatcttaaagtattttctgaaacgattggatattctggagatgtagcgcgccgcgtgaattgaaaaaacgtttcatttaaatcgcgaaaaattatattacgatgtttttatcaaaatacgcggtatatttagattattttaacatcaatagataattgctttttgcccattaattcctatgtctctgtagtcaattgatatccgtaaaacctccccaaaatgtatcttcattcctacaatcctgttcgatttcacaaaaaatcaggagctgtatcattcctcggtcttttcaatataagaggtaaaaaaacatgagtgatttagagcctatcccaataggattatattccagacaattaaactacaagccaaatgaagcatggcttcataattttcaacccgtttttcccaacgaaccagaatacgacgaaaacgattaagccaactgtgtgtcctttcaacaacccaacggttcactttaaaatcatattgttcggccagcgcatcttgttcttcttttcttgattgtatgcaggggacgtatccacgggtttttaattctttttccagccattccgcctcataagctttatccagatggagtttggttccataaccccggcgtcctgtctgtaaaccgtccagggtggctataacaagtctgatatcatgaatattagcgggcgcaacggcaatcgctaatggcaagccctgtccatccgtgagcaaacttcgctttacgccttgttttccccggtctgttgggttgcggcctgtttttttgagccggccaggggcgctttagtcaaacagccatccagtgccaatttgccccagtcgatagcccctattttttcactggcgagtaagccattttgccagagtcgctcaaagacgcctcccgccacccattcctgaaaacggcggtgagcactgcttgaagaacaaatccctgtggcattgagggcattccactggcatccggttcgtaacacaaaaaagatagcattcatagcggcccgattatcgacacggcggcgatggcagcccaaagggtgatgggttttatgtggagggagtaagggttcaattttctgccagagttcatcagaaatgaaccattgggctattgatttcttattcatgaaaaaatcccctaaatgtaaaaaaacaggctgactataatatcaaatatctcctattgggatacactcttagtcgcaaaagaaggttcttatgcatgggcaatattgcaactacaagcgggtaaatgcgtgaggagaaagaattgggatggtaagtatgctttcttaatacgtaacccaggactcactaatcaaacggtcaaagaaggtgattattgggcgcaagcaggtgtcgaagtgggtacccgctttaactatctgtctgacatagaacatcatgcatcatcaggcaatgtcatttcttgggttgccttaccgaatgatttagatggtaatgactgggaggtgcttacccgtgtatcagagccttccgatatagctagttattgggcgcttatgtccgtaacgccatctgaaattattcccggaaaaaaatggggggataataacgcgagaacagggactctctcttatccagattatagccttgacggtattttctggactcttgacgataagaccaatgatggtgtgttaagcctgcgttttctttaccgcaataaagaagatgcactgcagaaagctaccagtaaaaagctgacaataacagttagtggtgttgtttatcaccttggatattactctgcattgaccgaattttatgaacctcaatataggggaacggaagcgaagaaaattggtgaattgctgatgcaaaaaaatcatcctcttaaaattgaggctaagtggtataactactgagattaggctttcatttccccctagtttcttgttagggggaatatgactgttgtttttattctctcaataatgacttcggctgctccggccatttgacatcgggggcggtagagcagtccacccgattgagcagcaccatatattttttccactctgtcaatgccgcccgttcgctatccgtttccatttttaggtctacggcgtactgtaacggtgctatagagtttgcagctttcgacattcggtatcgtttctcatactctgcattttgttgtagctgctccggtgtgggcggggaattcgtaattgcgtcagcctcagcctcggtaatgggcacaagacccggttttatccacgaatcctgcgaaccgtctgattcatacgcgtacactttattatctgttgatttgtagtacttcatgattacctcaattcagaccatgattcgataaaattgccttcgctcgcgaggtacgcatcaacttcgtaattcgcgccaaccggaacgataaaaaatacactcaaaattgatagcgggccgtcataacctgaccaattatacgcaacctcaacgccatttacgctagcaccaatccccagcgcgacattgtatttttctcgttttttcgtgttaacgaataccgctatcggcctgcctgccgtattcgtatattgcctgccccccgtgcgttgagaccgaacatcccgccaactctggttaataccgatactcgcgttatctgccacatcagatagcaatgctatctcaccggattttttgcgcagactggcgtaatattgtgttttatttgcgccatctcggtaatacactgtcagcattacgggattttcatgcggggtagcagagaactgaacgtaataaccgtttgcgttttttaatttaagccccgcccagtcatgtgtcgcctcaacatccacaccgccgcacgaaaacgtttcatgcgattttttcagtgcataacggtcattcgcttctttcatcgaataggcgccaaccactgccgctgaagggggaaatgcttcactgtacgcccgcgaccagccgccatgatcaaaacgatcgtatagcttggtagccccaacccaccctttagcttcaatatccgccgagacacccgagacaaacaatttccccgttaatactccgccggttgtggggagcgcaccaatatttttcacaaactccggcttgttcggaatgtctgcgccgttctggtttttctccatacggctattagcattctcattaacttcagtcaccagtttctgactggcggccattttgctgctgttacccgttctgtcggtcagtgtaatgccattagcaacgatacttttgatggcaacagccagttgattcagtttgcttttatctggcgtgatacctgcctctttcagtacgcccaacaattcagcctgaatctggttaaaccattcctgaccgggatagctggcactcaatcccgcgcccccttcagtaaaccaaagggggacagaattgttggtgggggtgatggcaggcatcacgttgatacctgacgggttatcgagtccgaacatcgttattcctcactcataaataaaaacaaattcggtttcagcgggcgcgtaacgcgccagcaggcattccaaatcggcggcatcggcaatgcgtaagcgttgctggcagtgatccagtacggtggcaaaatgggttatcctgtccgcgacgtggacgaacacgcgaaaccagttgatatcggggtaaatgggataatggcagtcacgcaggcagtgatgcgggtagtgctcttccagtctgatgcggtagccacggtcggcagccaaacgttcatagaactgattgcacaggctgccggacatgattaattttgtcttgacagcctgacgacggctgttgattgatgactctttatcaatgctgcaatcaggcaatccgacaaaatcttcccaatcgtccagtaacacaaatgcccggtcggcaaagatttcttctagcaacacggcattgatagcatcaacccgggcgaattcttccccagtggccagcatcaatttggccagattgctgtcaagattttttgaccaggccaggccattcggcagcaattgcagccctgagcgttggtaatctttggctgtcatcgccatgtgatatctcccagcacaaaaatctcattttctgcggcgtgaatatcgccagtcgggctgaagactgtgttatcaatttcaccgggggcgttcgagatggcggcacggatttcagacaggaatgccaggccaccgggacgcaggttttccagatagattttcaggtgcgttttgacggcatcacgcacctcttccgtattgggtgacaggcgaatagcgaagttggtgactttcgcggccggactcatcacgatcaactccgccccggtggtcttgccttccacctgattggtgacggggttgatatgaccggtcaggtagtcttttattctgttcaggtcagccgtgccggggaagatgtcaggctcttcatccatcacgaacatcacgcccaccgtgccatgtccacgataacggggaatgcaccaggcgcgggtgacgccggggacttccagcgcccagcgctcgtagtcatactggttgccgccggaaggtggatactgcacccgaaacaacaaacgggaacgcagcgaatccatcgattcctgttcagccccgccgccgaggtatcgacaacgggcctgtgtctgaacattcaccaccggagaaattaactccagtggcacgccttcagcggtgttgcctttacggcctgcctcaatcgcggtcactgaaaccggattatcacccgcgatggcctggacatcatcaatagactctaacaccaccccatcagggcgctgccagcgggtgccttcagggattaatgtatccgcagacacggtcacggttaatatgccgctggcgttcgtggcggctttacgccagacaccccagaattcgcaatgttccagcagcttgtcatcatccgcaagatgcgggacaacctgccgactggtccacgccagatggtcatgcagtccggcagcattgcctgcattggcatacgcgatagcacgggttgtccgaaatgccgttcgggcataggttcccggcaaccggctttcaatgtcagcctgattgcgggcgattaatgttgaaagtgcgggggctttatacggcatttaaatcctgcttaacaatgttttaaaaggcagtggcaacacactgccatcaaataacgtgacagagacggtcaacagtaaaacgccggatgcaggcgccgtcgccattacatcgatttttcttacgtgacgctcatcaaccagccaggccagcgcttcatcggcgtaggctttggcgcggtgcagaacggcagacagttgcttttcacgggccagcagccagagccggctgccgataggccgtgagttaaagctatcgccccaccaaccgcgcctgtctgtccccgagcctgtcgggagttcgtcggagtcgagcgcccggcggtcagtgaataatgaaatgatgacggcggtgctgagtgaatcatccagtgcgatatcggcattattgataacaatatcggcaccgttgatttgccactgtaaggcgatatcattcattgcattcatcgggggggactcgtactgtatccgtcatgctcatggtgaatatggtctttaccactcgtctggccggacatatgatcctgagcctggctgatgccgactatatccacattgcccgtgaagcgggtttgtggcgtgtcaaacacaaccccttcttccgccacgacttccagccgtttacactgaatacgaacaaccccattttcagtgagtaagaggtgatgcccttccagatgatagacggcactgtcaccactcttcaggttccccagacggaaacggcggttatccacggcaatggcgaccaggtgctggcgaacgccgcccacggataacacgatcgcttcactgcccgcaggcggaacgctggtctgtccatagttctggaagcgttcgacatcatcggcagtttcttcagccagcaatgacacctgaatattctgttgcttcagggtgtcattcacgaagttaaccacaccccgcgataccagtagccggatacggcgggacaggctcgcggtaaatttattgaactgggcaatcatggtttccaccttatgtctctgactttttgttcgggttcggcggcttcggtgaagccgtcacggggcatcagttccagccgggttatcgtgccgttgtcgttatccagcaggtaattcacggagacgatcaacaagggttcatcggggaatcccgcttgcggggcctgtaatctgaccatgtcattgatttgccagagttggccaccgggtttgaaccatcccctgatgcccaccgatgcggttgtggaatgcgccatggcgcgcttttgttcccatgcggcgcgggcggtgcctttggctttcgtcatattgtcatcggccagaaagagagtcgggcgataacgcgtaatagccggatctcgcgcatccatataaatagccgttgactgtaccggggtttgggtttccccccagcggccgcccgccgccgatgcccccttgacacgatagaggctaaaccgctcctgccaggataaggcggtatccagcgttttgattttgacgcctgtcggcggggcattgcccaacaccagtgttgccacggactggctgcccgcggtggcaaaaaccagctcgcctgcggcattgctggtcactattgcgccccggtgccgggcagcacgggacaggttgtcaaagacggtttcaccgggttcgatttgccactggcgaaacaccgttgcggcggcggcatccttaacctgccagcgaacggtgaccccgaagggtttacacaggtctttcgctatcgtctccagactgacattgcgccattgcccccgaccatgaatggcagcgcaatccaccaaatcgcctgtcttgtcacggccggataacgtaatcgtgcgctcgtcggcattgatccccacttcaaccgcatcgatatatccggtaaccacccgctggccattaatggccagctggcaggcgtgaccgggtttcagtaccagcggggaatcgttatttctgacggtaatgcccagactaaactggccggacatctcttccagactgcgggtgacattcagtgttttccagccggaataaatgttattgcccagaatcaactcaatggtattagccattaatcacctcaacttccagcccgcccgagacgaacgcggggtgacgaatgccattgcggcggataaatcggctaatctgcgcgacactgcctgtttcacggtataacgccaccaacgcaggttcagtcccgaccacccgaataggccgtgccgtcggcaaggggaggaaatcttcgtcaataaagacggcgcgattaaagtgcattttcactggaaccgctatgacgacccggatgacggcgcttcctgctgggtacgtgtcgcgcagggctggaacggcaacggctatggctttatggccatcccccgcatcgggcaggaagtgattatttcctacctgaacggagatattgaccgcccgattgtcaccggctgcgtttataacggcctgaaccgcccgccgctggatttaccggcgcaaaagacccacacgacctttaaaaccaaaacccacaagggcaagggttttaacgaactgcgcttcgaggatgcgaaaggcagcgaagaaatctattttcacggccagaaagattttaccgcccatatcgaaaatgatgcttactggcatatcaagcacaaccagaagagccgcatcgacagtaaccgctaccacgatatccgcgccgatgaccatcatcaggtggccggttcgcgcaaaatcaccaccgaaggggatgtgtcacaccggattgccggcagccagcatatccagaccggggatgccacagtgtttgacagcgggcaagaaatccacctgaaaagtggcggcaaagtggtactggaagcggcatctgaaatcacgctgaaagtaggtggcacgtttctcaaagtcacgccgggcggcattctgtgctcaccgattaatgtcgggcaaggttcgggtggcagcgggcgcgggctggcattgcaattgccggaaggtgtagcaccattgccgatggtggaattcccggctcatccatactgcccgttactggcacagcaggatgtcagtccggtgattaaacccgccaaaaaggaataatcataatgacggaagaaatgatgacagaaacagcaacaagctggcaggcatggctgaataaatccaatgatgcatcggtattctttatcctcaattcgctggcgcaacccaatccggtcgatcagttttaccataacgactgggttgagcaggcatttccgctctacagcggtacgccgatgcacaagatgctgaaacaaagcccgtggctggtacaggcgaaaagcagccggctataccagataggggagatgctggagcgccacgcactcagtgataacagttggggctgggcataccgcagtcatataccttggcaggagcagcttacccactggcaacaccggcaactggtcatgatgaatggcgaacaggtgctgttccgcattatggatgcccgtgtttttagcgcgatgatacctgccttcactccgggcgactggtcactgatgctgtcgcctgtcacagaactgatgatcgacacaccacagccggtgccgttttgccgtcccaaagattgcggagaaggtaaccctgaaattccgtttacgttaggcgaacacctgctgggcgtttggttatgctccccttacggcctgaaagtgttaaccagttcactatattgtgatttatgggaaaagcacggggcaatggcgaagcaatgggatcagcccgcaggcagtttagaaccccggattgaacagtggttgaagcaaaagctggaagccggacaacgtcttgaaaaagtatccggtcaggattacctgctggcgctggaacaggagaaagctcgatgagtaatgaaaactcgatttatacccatgactgtcagaaaatacttaaaaatgatttatacattaaaattatcgaagatagcacgaatacaccgataccgaatacgccttatacactgaatagcaaaatggtgcattcaggaatcagtgatggtcagggtatagatcttgcagaagggctaaccagtacgcccttcacggtcaaaatagaaccgcctcagtcagtgtagctgttgtgcttcattaagtgaggtgtataaacggcggtatatattttagtaacaggatgatattgaaactatttttatcaggaagacggacatgatcgaaatcttaaaaaaacataaatatgatgatttggctttacaccaaagtacccaacctgtcgctgcgtgtgattgtcatttcgaagaaaaagacggaaaacagattaaagttattgatgtccctatactcacctgtgagtgtgtctggcgcaggtatcagaaagaggccgaagacattgttgcacccggtggtaaactgattgccgaccccaaagaacgcaataaacgtattaacgcggcttacgcgaaactttggctgaacgacaatcgcttccaatgggcggggcttgctgcttttgcttctaagcaggtggggtgcgggttgttgcatgcctctgagatggccaaaaagaatcaagctcatcaagatgccaacagacgtgtgcgtcaaagcgcaaaagaattagaacacacaatggataacccactttactttcttcatccaaagttaaaagctcaaggcgaaatagcaattgaagattttcctcgtgccatagaagaagccagagaagccagtagaaacaataaattatcaatattttccaatgtgccgggtcttcagccaatttcgggtctggcacagtattcattcaattatgtctatgacatgatggcgctggggaacacaacattatttttggatgtgtatccattgcatgctttttataagcaacgtgggttggaagaactcaaaacttgtataaagaagcgtgaaaatatttatggtaatagccaattcccaatattgtggccgataggacaagaaaaatttacatttggccgtttctatccagatattctattcgcgtttgaagcgatagaagcaggtgatatcgctcaaggtgttgtgcatcttgccaaccacgagcaaatcaacatattacaacccactatgtacagtgatactcgtttagtaacattcttgtttggcaatcagatttcctttgtcacaggactcccttctggtgtcgcggaatctgttgaattaacgctggcgagtcagtgcagacgtgttgatgatggccgtactatcgaatttagtgatgaggcgctggccgatctttccgatataaaacaacgtatgcctttcgtgtacaaggcagcagaacggtttgatgagatgctgcatgatagcaaccgaagtttactcgaagaatctctacaaaatattgcagcagggcgaggtgtagaatgagtttattacaacaaataagtcggcagcgcggtggtttaatcttcatattattaatcgttttcggcctggctagcgcttatctttaccattctttttattccgataaaccagagatagcgctggtgatcggtgaaccttacgaggatatgcggcagcgctccagtgccgatattgatccgcatcttccgggtaaaatttggcataatattcccaaaacagatgcccgtttacgctttatcgatccaaaatatggatttgttacccctccagcccgattttttactgttctatatgcgaatgacattattacgagtgtacgcatgtctccacaaatcgagccattaccctacgatgatgcaatcaagatggtcttggatttacaagatcagtggcgtaaaacgggttgggtgatggctaaagggtataaacccttagtaaatacaccagaactgcatgaaaatcttcgtcgtatgaaaggtggtgcaggaacaacctattggcaagctgctgatcagtatcagattatgctgagtttagcatttttcaaggacgacaagcatcccaatgacgaacggtatttgatcacaatggtaatttataaaccgtggtaagcaggggatagcacaaaccaaagtgggtgtgagaatgttatctttcacacccactattcaggatattgcttcaggacgaggtataaaatgagtcttttacaacgcataggtcggcgacgttctggattaatctttgcattattaatcgttcttggtctggctagcgtttatctttaccattccttttccgataaaccagagatagcgctggtgattggtgaaccctacgaggcaatgtggcagcgatccagtgcaaatattgctcccaaataaataccctaataacatcgggttcaacacacctaaaactgatgcgcgtttacgttttactgatccgaaatatgggtttgttacccctcccgcacgattttttgttgtgcggtatactgatggaataatcaacagtgtacgtatgtcgccacaaattaagccgttactctacaacaatgcgatcaagattgtattagatttacaagatcagtggcgcaaagcgggctggaagcttactaaaggataccattccttggttaatacaccagaattgcatgacagtcttcgtaagatgaaaggaaccggaatgaccttctggcaagcaggtgacaagtatcagatcatgctgaatatagcgcgtttcaaagatgatcggcatcctgatgaagagcgatatttgatcacgttagcaatagccacaccgtgggtaaatcagtaaagtaaactcagatgggtgtgagaacattatttctcacactcgctatttagaacgatactgacgcgctgcgcttgtcttctccgagttaccgggctaatgaattcacccggtaactcggagaatcgaagaaacataatcgttacgattggttatctctataccactacacatattttcacggaataacggggtaaatagcatatttattatatatttcatttagttactctatcccatattatcccaacatatcccgtaatagtgtgtcactactttaaattcaagatattaatacctaccagagagaaattttttttcgggataacctccattgttataatatttatttttgtaataacactacgttacgggatatactgggataacacgggataattaaaatatttataacttattgatatagtttaaaataaatctctcttatcccaatatcccgttatcccaacgtttttttaaccctaagtgagagtcaatcttcatccctgaaaatcagcaccacaaatcgcccctgagtgccgtttactgaaatggttttgctgataaagcgatctttttccgctttaaccagcattccggcttcttctaaggcctcaaaaccggatttcttctgtaatccctgcaatatctctgcttcaaatacactgggaataatgtggtattccgtttgcccatcattacgacggttatgcaccagatacccggcaagatcgctaattctcatggagtgtgatgtatcaatatcaccatttggcctgccgtaggtataaggttggaagcgtgaaagcccgtatttttggataaagtcacgagtacgggtgataacctgatatttttcccgatttccgatgccaaaatcagctaaccaatcatcgaaactttgctttatcgccgcatgactcgcttctttactccagccggtaatatggattgccagctctccggcagcatccagtaacgcgaaacgaacagcaacgcgcttgacttgggctgaggcttcttctggcaggccatcaagccactctttttctttacgggcggttacttcgattacctgctcctgatttacagacaaccattgaacccatgcccgacccgctgcaccacaatagcgtttggattcacgtttgatggctcttgcatgagaatcaccatcctcatagccattgaaacattccgtatcaataaagggcacactgagcaacctgacaagctgcccggcttttggggtgatcccaccttttatcaggaacgtttctaaatcttcctcgcctgttgaaagggcggcaattttccagcggatcaccgcacggttcccaccttcccgtttcccctgaatttttccgacaccgttaaacaggctataggcactgttagcgatttctttcggattcgaactttgtccgatttcgtcaatgggcatgaaaccatcattacgagcagcggcttcattatttaaaaccgtgattagtaccgtgccacgataatttaagttcttcgggatcaccgtataagctgctggcagcctcaacggtggtggttttccctgcggaggattgggcgaatgaatgcacaccaaagcagctaccacctgtcagtgagttaagtggtgcagacaatcccaccagtacgcccagcatcattgaccggttgcctttcagtaatgacgcaacgtgcattttccaatcttcggctgttcctctgaccacataaccggcaattgcggatgtgccgccactgaacgcgacaggcatataaggctgaccgatgatttcaccgtccggcatcacataagccccgcagtgccagcctgctttctgtgtcacaatccattcacggcgatcaccgctgcgttgcaggtgctcagctaaaacaggcaataggctattttttacggtgatattcattccccgtgaacgcaatcttgcccagcctaccggcattccgatttcacggcggggaagcgcttcaatgatacattttcccgttccttcctgatgcagcttaataatgagatagccttcgctaccatcattgccaatgccgactatctccatgtaatcactcaaccatttttcaacttcgacgattttgccaccttgctctttaggttcaacccagtaaattccgttcttgcgaatatcgatatggggttttagcgggtcgtattctttctctcggtattcatctgaattagcggtcacagattttgacaccgctacgttctctaccacctgatacaacccattactgaatgtctgttttgctgactcaatgccatgctgctgacgataatcatcccagtcagctttgtattccgtggagggcaacgtaacccaaccattaaccgcaagggcaactttttctgctgaaatcttgccgatatttacctttgggttgccgtttttatccagttcgtcgggatgatgccagtcgttatctgctgccagaataattttcgtgtccggccagcgctcccgaacggcttttgcgacagaaagcaaattgcctgcatctagcgctgccaaaatagtacctttatagaactggttaactgtcaatgctgtagcataaccctcggtaatggtcaccgtatccgggttatcttttagctcagacagcgcgataaacgaacctttcttctggctgccagacagtaattttttctcaccatcaggtttgataatctgtgcacctgttactttttcgtccaatgttgcgagtcgcaacactgccgaattatcggacagcagccgctgattagggcaatgcagcccctttgcggtcagatagggagactgcccagcaacagtttgagccatcagtgccgcgactctttcggcaattggctgtactggataagtggtttctttggctggtttgagttctgacaaaggtaatgccagtacgttagcaacaatcttagcagcctcaagaactgagatacggttggtttttgctactaaatccaatccatctccgtagttcggaagatcacactggcgacagtgccagttgccgtgatggtggtcatcaataaagtgaaaacggtcggtgccgccgcagacagggcaagcgctatgtttaccctttgcaggaatatcgataccacaggcaggcaacagattttcccaatggtacatagcggattgcttcacggtttggataaattcgaacggtttttggctgcttgatttatccaaagatgtaaatttaggacgagtttggttatgctgtgtatcagccattatcgttactccaattaacggttattggtcagacgcctcagatgtgttccagcacgctgggcgttgttttttcatattgatataggtaatgtgtaatgacacataaacacattacagtgagtgtaattgacatgtcaacacacaaaaatactcgtcggggcaatcccccattccaattcagacttgatcctgaactacgggcactcatggaaatagcccaggcacaagatggtgatgaatctttagctgcgtggattaagcgcattgtccgtagagaattgcagtcaagatgtattgaatctaacccctgaaaaaagcaagttgagggtaggcaagtgctacccttagtttttgtattcttatcaaatggtaggtacatgtcattaaataccacgagattcagcaattcgttgatctacccagccatcaatttctgattcaacaaacgcaaccgaccgagggccaattttgacttgtttcgggaatttatcttctttaatcagcctgtagatccatgccttgctatagcccgttctgcgctgaacttctggcaggcgaataagactttttttagatgttgtaattgttggcatgtatactcccctgttatcgagtccttgaaatgccttggtagacgttacttgatgacagaggattatttaaaaattctgtttaattgaaagcgtaaactctttatgcaattcgtaaaattaaatgcggggtattgactgtatgaaaaacaggctattgtgccccgggcacagaagattaaaaagcaatcatgtgtataatgaatggtttttattaatgaattgaaaaataaggaaatatattatttattcagagactggagctttaactatctattttttgtatgaaaaacagtcttaaaaaaggatgaaatatcaccatatgatgattgttatactatgatggatttatccgttactctatctggcaggattctgtagaaaggtacggctaaatctgaaagtcggcgaggagcggaatttgtgttatgtaaacgaagggaatgtcataccctgatagatatatttccgttttttacttccgatgggatagtcgtaataaactgatgaacctttgcaactaatgatttttatttgaatttcacgcatgatagacccaatattctgcgggcggtcaaaattcctactgtttttgctaaagccaaatccattcagatccaaagctcgccataccttgccgtcaaatatagttgcatcgataaatggcgttctgccaacccctgggtgaattgctacatcaccaatggttgcaagggcaagggataccttcgaaggataaacagttccagagagtacaagttgagtagtgggaggcatttgcgacaggtccttttatgttattaagcctaatgtttatttgacggagaaatttgtgtttaaaacatattttctcgcatttgcgggttcattatctatcatgaaccatactctacttattattaagattccattagttgggtgtaaaagtgttatgaaattagcggaggcaagtacatcatgttgctcccaattcagaccctacagccacatcttcagcaccagagtgatcatgcagctcttcgatggtagctcctgtcatcatgctgtagtggccaatttgacctgctttaccaaagatgcttcgaaagacacgaagatatgcttcattggtttgctcaccatggttgatgtacaggtcgtcatgaattgagtgagagccatcgttgacccaggaaaatagagattggcaaatcaacttgtcacgtccttcgaagagtgtacagatttcatctttactcattccaccccacatagtgaagtagttttccaatatgcggcgtaatgtattttgcaggctgatactggaaatgttttttgatttcacattttcccatagaagttcataggctgaacggattggattagtttcataacgctcaacaactgaaccatgctgtagctttttgaccagccagaaactttcctcattgagtacgccaccggctggcctgctcctattgaagctgatttctttgtgaaaatagacattatgagtcagtataaatatctgtttgatcgaagagctctggtttcttgcctcatccatcacacttttcataagactgctgacgatatagagaatatcgctgtctaacgaagatatgggatcatcaaacacaactacccgatttgttgtaatgcctgagggggattgagcccctttgatgaggtagtaaaagtacaaaaaagtgataaatgttttttcgccttcacttagtgaacggcctacatcctcaccgtttgcacgaattattcgatagtgatagtcttcatcggcctcagcgatagaaaaggaatggaaaccgaatttctgtagtagatcgttgattgctgaaatagttggttgaatagatgtagtttgtttttccagctcttttacttgattttgtagacctcgaagctgtattttctcttccctccggcttttttccatgccttgaatggttcttgtcagacgatccttagtttgatgatatagctgcaagtcgtccgctaattcatttaatacataacgccagacttgagaagttagtgtctgcttctccgttgcaatattagccatagtttggttatgacgggttgtcgcttcattggcttctatcaccaaggcctgcaactgtgtgatcaggggttgaactgattccagctccatttttcggcttggttcatcaagcttgtttaccaatttggattgattgactttcaatcgttcaacaagcgcttgggtttctgcattaaacagatctatgtttaggaacggattattaatttctacgttgcgctgtatggcagctgtcaaccgatcgcttgccttctggtagttcgcttgcaactcctttagcaattgtatgtcgttgtcataggcttcgctaaagaatgccgtgagtttattagagaaatgatcatccgttggctgctggcagaaagggcatatctctggattctgctcatgatacttacgaccttgttttacccaatcgctgttacccagacggttgatgagagctgcaatttcaatatcttgattcccgacaatcactttttgcagtaatacatgtccttcaacgatgacaagatcatcggctaacaaattcccaagtggtgtgacgcgctcaatattgcttgaaaaaacagtttctgctttttgttttagttcctctaatgaaagcaattccgccgtattagaatttgcttccgacaacactttctctttgaatcgttctttgttacgccgaacacttgctgcagagtatgcttccttaaaatcagcatcatggagctccttttgcttccaacacttatcacgcagtgtaggttcgaggtcttcgaggccttttcttttaccgggctgctcttccgaaccatccaattggatattaaggcttgatatttgctcatttaccttagctattttagtctgtaaacgagcgattttgcgctcagcttcaatctgattttcacctaaggtaaaaacaccctgtagagggtcgtcctgattaaagtttcgatcaacgaaatccctattatacaccatccgctcaagctctatgccgccttgccattgaagttggcaatgttcatggtcatgtgcttgagcaattacacgactaatggtcgtcttacctgtaccgttcgcaccaaaaatataattgatgcggcggagatcactgagccttgcagggttctggtaggtagctagtggtgaattgatttggatttcgccgatcatgtcctctcctcagagttcgcctgaaaaggctttttttttctgatcgataagaaattgttgctggtagcctcattgtcttcgcattagttttcaatcaactttgctaccttttctgaaatagctttgtattccttttgttcattgataggtacaataggaatcggcattaccttgatcattcaaatgttttaatccatctattatcagattaaagataaaataatgcaaccacgggttgtataaaaaatagactttattggcactaccaacaaagtctaaaaaatcatcttttattcagtgtgttataagtattaatgaatgttacttccgccgtttcttagcaaaatcatacggagtgatatgtttttcccggtttgtatccagataatcagcccaccactgaaccatcagtcgccgttcatccagatgcttagatgtgtgaatataagctgctctgacgttttttctttctacatggcttaactgacgttcgatggcgtcatcgttccataatcccgattcgcccattgctccacgagccattgttcggaacccatgtccgcaaacatcggttttggtgtcgtatcccatgccacgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgacccagaaatgaaccattgggctattgatttcttattcatgaaaaaatcccctaaatgtaaaaaaacaggctgactataatatcaaatatctcctattgggatacactctaagtaacagcattatacaaattaaatccacgataaatatctcaataaaataaaaaccaataaattcactaatccattataaaatttcttattaaaccaataaaaaatttatttaaattaatttttaaacttatgcaaataagacttacagccatactttaataagtattattaaaaattatttcatttaaacaattaactatatttattattttaaataagagagaataatacttgacattctccttcagctagttaaaaattaattttagtatttgttttataatacaaatggattattacatgttattttctctcaataaacacaaaatagaaaaccgtttacaattctgtcaaaaaagatcacaatactttctattatttaatgtactttatcgggtgcaatcaatataccatactttaaaaagtattgtttcaaaccaaataaacttgtcattgataccattattgatttttacaaatcatgctcaggcaagcgatttcgtcaattttcaatccattgacaccagcctttacctacaattcgaaaataaagttgcccctcagaaaacgatctctcccattatagaggcgtatggtgattacaaaattggcgatatgtatgtttacagtatttggcaaaattcgctgcaacatgactatcaagacgataaaagcacctattactataaattcgtccccagactcagtgccagcaagataacggggtatgatctttcctatggcccgttaaaagatgtgctgtttgcccagtggattgccaaaaccaaaaacgtaaaatacgattatttccccggtatcagccttgactggcaagtccccgggtttagctggctgcgtaccctgttttattttgaaaataatgcaaaaggaaattggaacgatcaacgaattcatattgactatgccattcctttcaataatcaattgggggattttcggatcgtagggacgttagattatacgcttgggttacacgataatcctgaaatgctggagttcaagccagaattgcattatgacttggggaaaaaactgggctatcaatcagggcatttatggacaggccttgttctgaatacaaccaagaataagtacaaaataaaagatacaccgtactatcgcacgaaccaattcagctatggcgtgtttattcgatacagctttttctaataaacacataaaatagtgccgtttttagtggtttatagccttttatggggtcacaatgtccattcaacacgacaaattcgggcgtacttatcagtggtttttgctggtacttttaggtatggtatattttttatccacagcaacaacctttacgtcattgggcgttgttctgcccagcatgatcaacgagctgggctggaactggacgaatgcaggtttgggattctctctgcttggcctgacctgtggactttccagttttctgccaacattgttcatccgtaagattggtgtccgcttcaccctcttcattggtctgctgatttttcttgccggtttctatcatctgtataacacccatgtcattttatcttattttatcgggacagccttattgggtatcggatttacctttttagcgacagttcccggcacttatgtcatttcacggttatatgaaaaacagtcccttgcctttggtttctatttcaccatcggtgggctggggggcgtcattggcccgtggatctattttctggccacccgtgtctggggaacatggcgtatgcactggatgatttccgccattgttctgaccgtatttgtacttctgactatatttatcctgcaagaaggcaaacgggaagttgcccatgccaaggccgttaatcaaaagcacaatagccagaaccccctgaaaatttatcgcactaaacagcgctggactgcacggagagcgctgcgtacatggcaattctatgccattgccgccacttacactgcgtttttatggtgtggtattacagttaacagttttgccgttgcgcacattatcgagaatggcttcagtgaagctatcgccgcagggctgctgagttcaatggcctttatcaatgctttttcaagactggccggaggcgcggtaggcgagtggcttgatccgaaaaaattgctgattggcagcctgaccgtcatcattattggtttgatctcgctgagtatcgcgtcttcatggcctttcttgattggatttacgctatttgtcggtatgggctatgggatgactttcctcgcctccagtgtcctgcttgccaattattttggacgtaagccttatctggagttgttttcggtcatgaacctgatttctactctggcttgtctggcacctttttttgccggggcggttaaagattattcaggcagttttacttcggctttcctcattattgccatccccgtatgtgttgttcttgtcgtaacattgatgatgaaaccgcctgctcaaaaaatgaaaaagcgtttagtcgacaattccccattcaccgaatagggtaatagacgaactgaaaccgtgcacaaacaaggaaatagtgatgtcaaagaaagagttcggtgtattcctgcccatcgctaaaggcgggtggatcatctccaaaaacacgccgccactggatgcgtcttatcaacaaaaccgggaggctgccattctggccgatcagattggccttgatttcattatgtccatgggtaaatggcgcgggtttggcggggaaacagaccattggggtagctcactcgaatctgtcacgatgatggccggcatcgctgaggtcactcaccgcgctaagttgatcgccacggttcatgcggggctgcacaatcccgcagtgacggccaaaatgatcgccacgttggatcatatcagtcagggacgtgcagggctgaatattgtttccggctctttcaaagatgagtttgaacaaatgggcgaatgggatggcagtctggatcatgaccagcgctacgccatgaccgaagagtggacacaattggtcaaaaggctctggcgtgaaaaacatgttgatcatgaaggaacctattttcacctgaaacagtgtgtttctgaacctaaacctctttcactgccccgtccttatctggtttgtgccggccaatccgaacgtggcctccatttcagtgtacgtcatactgatgtctgttttatcgggggcaaggatgaggcagaaacccgcaaaattagtttaactgccaaacgcatcgcatcagactgcaacacaaccaccaaaactttctgcatgtgtacagttatttgtgccgaaaccgatgcctatgctgaaactctcgctcagttttatcgccaaggtttggatgtggaagcggtcagaaatatgatgcacagttttggtgtcgatgtagatggtaaaaacaatgccatggttgaacgatcacaaaatgctttcatgacccataccgccattggtacgccagacacctgttacaagcaactgtcagatttactacactcctgtgaactggatggcctgatgttaattttccctgattatattaaaggattgaaggtattcggcgatcagatcctgcccaaattgagagctgagttcggctgattggcctatcccattcacctgccagccaatcatgattcctttgacaaatgggaaacctcatatgaacggtttcccatttattattaatagttcggtttattccggcaaacgccggtgcagccctttaccacgtaataatcgaatccctaaccaactaccgcacaatgaaagcagcagactactgatgataggaagcaggaaccacatctgccattgcggttgccacgggaactcaaacacttttgtctgcaacagccagagtgccacttccgcacccaatgccgcagccagacctgccatgaaacccagcaaggcaaattcgctccacaatgtgcgccgcaacagttttttgctcgcccccaaagtacgataaaccaccagctcaagctgccgttggctcatgcctacctgaatctgtgccagcagaagcagcgcaccacaaatcatcaccagaacaaccataatttccagcgcctgactgatttgctgcaagatcccctgtatttgtttaagcatagtcccaatgtccagcatactaatggtcgggaaatgacgatttatttccgtgagaagccgcccatctccttcataatgaaaactggtcaaccatgtctgaggctgattatccagcgtctctttggaaaaaataaagaagaagttcggatgcaggctttcccaatcaaccttacggatgctactcacactgacctgaaatgtctgtgtgttacccgtaaatgtcagtttatcacccacattaatttgcagctgttctgctacgccctgctcaatggacacttccttcggtttcggtggccacgttccttccacgagagtattgaaggggggtaattcggccttccatgtcagattgagttcgcgacgcactgtcgtgctcttgggatgcctttcgtcagcccattcaatcgccgactgcccattcacttccgtcaaacgcgccagaaccacaggatagaactcagtcggcttcacttgatatttcgccagtaagtcattcactggtggaatttgtgcctgagtcatgttgatcaggaaataattcgggctatccggtggcaattgctgctgccatcggcttaataaatctcccctcgccatcacgagtaatgccagtaacatgaatgacagcgaaaatgcagccaattgcgtcatagtctggaacgggcggcacagcagccgattaactgccaaacgtaaactgagctggcgaaatttcatgcgacgcagcagccataaaccaccccagcccaatattgccagcagcaaagcgacaaccggcacacccgccagcaatgaccataggagcggcttagtgccagccagtagtactaatccccccgtcataatcagcgccacggtgggcaggtagtaacgtaacggccagatcgccgcagtgatatcactacgcaatacccgtgacggctgcgtcgccattagctgacgataagggcgaattcccaccagcagagcaatccccagcagcgaacctattgcccacatccacggccacatacccgcttccggtaacgtttttggcagcatcgcagccagaacccgaatcaaagcggattcaaaaatcaaacctaaaatggagccgacaacaatggcagcgagcaatatcaccagccactgcccgacgatccactgacgcaacgcccaacgccctgcccccagtgttttcaagatcgcaatcaggttatgacggctgcggcaatagtgcgtcatcgaaacagctaccgccgccgccgcaagcaacaacgttaacagtgccgacagcagcaaaaattgctgggcgcgatcaatagactgagccagtgcgccgctgtcctgtttcaatgtgagccaacgttgatccgcttttaattgtgggtcaatccattgctggaatgattgtatggactctggtgagccggaaaacatatagcgataagtcaggcggcttcccggttggatcgcgcctgtcgctttggcatcttcaatattgattaaaatacgcggagaaagctggaatggattgaagccactatcaggttcctgaagcagctcaccacggatcttcaataccgcatcacccacgtcaagactatcccctactttaatacccaatagcaccagtaagcggggagcgaccagcactgaacctttttccggtttcaatccctgtgggtgggtttccagttcaccatacagcggataatgttcatcagccgctttcacctgagccagttgcggaacgtctcccgcataggtcatggtcgaaaatgagatctggcggctcaatgtcagccctcgttcctgtgcctgtttcaaccaggattcatcaacgggataagaagcctgcaataccagatcacccgccagaaaatcacggctctggtaatgaacgctctgatcaatccgatcgctgatgctccctaatgccagcacacaggccacggccaacgtcagggacagccagacaattaatagcgatggtgtccgccattcacgccaaaaccagcgccagatcatacttcctcctgcaatgttccatccaccagacgtaaacgacgctggcaacgggctgcaagccggctgtcatgggttaccaaaatcaacgtggtggcgtaatcgtgattaagggaaaataagagatccgcgatgcgatcacccgtttgacgatcaagattaccggtcggctcatcggcaaacaggattttggggcgggtactgaatgcccgtgccagagcaacccgctgctgctctccccccgaaagttgggctggcatgtgtttcaggcgttgccctaatcctaactgtttaagtaattcaatggcattctgacgactttgattttccgattcaccgcgaagcagcgcgggtaattggacgttttccagcgcgtttaaagttgggatcaacataaacgactggaaaacaaaacctacattttttgcccgtagctgcgccctttgttcttcgttcatacgactgatgttttgccccaataagtggacttcgccgccgctgccatcatccagccccgcaataatacccagaagggttgatttccctgatcccgattctccaatcaaggcaattgtctgcgcaggctcgacaaccagctcaacaccttgcaatatattaattacctgttccccctgaccaacatgtttagtgagatgatgaacttcaagaatactttctacagccatgtatgtttccttttattattggtgctatgcagcgccagagcagccgcagcggataccctgcttatattgggtgatagccttagcgccggttatcgcctgcctgttgagcaatcctggccgactctcatggcaaaagaatggcatcaatccggcaataaaacggctattgtgaacggcagtatcagcggtaataccacggcacagagtcttgaacgcctgcctgaattgttgaaacagcacaaccctaaatgggttttggttgaactcggcggtaacgatggtctgcgtggtttttccgttcaacaaatagaacaagatttgcaaaagatcattactttgattaaacaggcagatgctcagcctttattaatgcagattcgtatttcgccaaattatggaaaacgctacacccaatctttcactaagatttatccttcattatcggagcgtaatcagatcccactgttaccctttttcatggaacacgttgctatcaagccggaatggatacaagatgatggcctgcaccccaaccaattcgcacaaccttttattacccattggatgtctaaccaactgtcagcatacatcccctttaagtaaaaatatttattaatagtaaatcatttatttcaataaattgatgtaaataagcaggtaaagttatgcaaaaagcggttcttattaccggatgctccagcggaatcgggctggtcgccgccaaaatccttcatcaacgtggctaccgagtatttgccgcttgtcgcaaatccgctgatttagcacatatgcgcgaattgggattggaacccatagaattggatttggatgataaagaaagcgtcgaacgtgccgccgagcaagtcattcaattaacccatggacgtttgttcgggttgtttaataatggaggatttggcgtttatggcccactagaaagcgtttcccgcgaactaatggaaaaacagttttcaactaatgtatttggtactcatcaattgacctccctattattgcccgccatacgcgcttatggtaaagggaggattgttcagaccagctccgtattgggattaatctctacaccaggccgtggggcatacgcagccagtaaattcgcccttgaagcatggtcagatgcgttgagaatagaactggcagacacgggaattaaagtcagtctgatagaacccggcccaatcacgacgcgttttacagaaaatgtgaatcaaacacagcgcgatcaccctgtcgaaaatccaggtcttgcagaccgtttcagactcacccccgaggatgtggtcacgaaattgattcacgctctggaagctcctaaccctaaaatacgttatccggtaacattattgtcccatgccatgacaattctccggcgtatattacccacgagattaattgataaaatcgtgaagtggcaaagctaattaagattgaaaatcctgctgattaaccttatttattcatgtcatcgccttataacgaactgaagagaaacgtcccatggaatcgataacgaacacgaatagccataccgcacacatcattcatatcaatgaatctaatattgcctcaatgattcagcattcactcactcagcttgtcgtgttctatttctggtctccacagaacctgcattgccatgaattggaagaaacccttgataagctggcgcatgagtatgccgggcaatttgctctggccaaagtcgattgtgaccaattacctaatgtcgctgcgcaatttggtatacgtactgcaccaaccgtgattttcgtacaagaagcccgccctgttcacggttttgagggaattcagacagacgaaactatcagagaaatgttttctcaatttctgactcaacagaaaaaatcactgttagagcaagccaatgaacgacttgcagaagggaaaaatcaggaagccttgcctttactgaaagaagcacaccaggccgagccaaaagagactgagattacattactattagctcaggtatatatttcgctcaatcaccttgaagacgcccaaaacatcttggataccctcccattagaagaacaagatcaacgctataatgatttgctggcaatccttgagtcacagaagcaggcggcaaattctcctgagattcaacaactccagcaagcgttagaaattcagccagaaaatgctgaacttgctgttcaacttgccgccaaactgcacaatgttggtcgtaatgaagaagcactggaactgctattcagttttctgaaaaaagatctttctgccgctgatggtgcagtgaaaaaaacgctgatggatattatttccgctctcgaaaccggagatacactagcatctcaataccgtcgtcatgtatactctttactttattaattaagtaatacttatatattccataattagctaataaaggaattgttatggatttactctctttcggtactgtacccattcttatcattattgcagttgtcatcgtctttacttgtgtgaagaccgttccacagggctatcagtggacggtagaacgcttcgggcgctatacccgcacactgacgccggggctgcatatcatcatgccatttgttgatcgtatcggccgtagaatcaatgtgatggaacaggttctggatatcccgtcacaggaagtaatttcccgtgacaacgccaacgtcaccattgatgccgtctgctttattcaggttgtcgatcccgtgcgggcggcctatgaagtcagcaatcttgaactggccatcattaatctgaccatgactaacttccgtactgtgctgggagcaatggaactggacgaaatgctgtctcagcgcgatttaatcaacagccgcctgctgactatagttgatgaagccactaacccatggggtgtgaagatcacccgtattgagatccgcgatgtacgtccaccgaaagagttggtctctgcgatgaacgctcagatgaaagccgagcgtaccaaacgtgcagatatccttgaagcggaaggtattcgtcaggccgccattctgaaagcggaaggcgaaaaacagtcacagatcctgaaagcggaaggtgagcgtcaatctgcgttcctgcaagctgaagcccgtgaacgtgccgcagaagcagaagcgcgggcaacaaaaatggtatctgacgccatctctgacggtaatattcaggcaattaactacttcgtcgcccagaaatataccgatgcccttacccgtattggagcagccgataacagtaaagtcatcatgatgccgctggaagccagcaacttgatgggcgctatcggtggtattgcggaattgattggcgaaagcaagaagagcaaacaggataaatagccatgattgaacagattgccactctacccgtctggttctggctctgttttggtggcctgttgctgattgcagaattgctgggaacggggggatatctcctgtggacaggaacagcggccgtcgttgtcgccttgatcacatgggttttcccggagatgagctgggaactgcaaggcattctgtttgctgttctgacattgctgtctgccattgcgtggcgtagctggctacgctatcgtccacgcaaaaataacgatgagacactcaatcaaaaaaaccagcagttaattgggcttcatgcccgcttaaccagcgcgaccgaaaacggctatggccgggtcaaactagccgatggcagttggcgtgttcactgtgacagagaacttccagctaatacggaagttgaagtgatcgccgttgacgggatcacgttgaaagtgaaacccgtcgcaaatcaaccgtgatgcgtacaacagctggataattgctcaatgatggggcaatctgccccatcatctcccggacattccgccgccagtgccagcaatttttcccttattttctgcaatttcaccatagtgttttctatttcagccactttttgcagggttgctgttttcacatctgcactatggcgacgaggattgtgaaacaaccgtaatagctcacgacattcttcaagcgtaaaccccacttctttcgcctgacgcaacagggtcagttcatcaatatgcttatgctggtaataacgatagccattatctccgcgatccggcgcagtgatcagatctttttcttcataaaaccggatagctttgctggttaaaccggtcttttgagcaatttcgctgatattcataatttccccttgaccctccccttgcaggaaggtttagccttgatgatatggccgctatttttcttgagttatcaatatcactatctttgtatcacggtaaatagataaagctaagtatatcactccgtatcaggaaggagattttgttatgtccacaacaactattcttacacttcaggggttaacctgtatgcactgtgtcggcagtgtcaaaaaagcattggaaaatgtatccggtgttgaacagactgatgttacccttgattatgccaaagttatcggaaatgtatcctccacagttttaattaccgcgattaccgatgccggttatgaagccgtcgtcgccactcagcccgatattgagttacaactttcaggcttaagttgtatgaaatgtgccggcaaaacccaaaaagcgctggagtcggtagaaggggttattgcggccaaagtcgatactcagactgcgaaaatttacggcaaagtagagagcaacgctttaattaaggccgtcgaacaagccggatatcacgccgagttggcggcaggtacacgcttcccaaaaactgagccgctgacaatatctgccccacaaacaccggagtttttggcagcggcagaaaacgcaactccggtcagaaatcccgaaaatacagtgagtcatgatactcccgataacgacaatgacagtattcagcttctgctggatggcatgacctgtgcaagttgtgtcagtaaggtacagaaagcgctgcaatccgtcgatggggtggaaaatgccagagtgaaccttgcagaaagaagtgcattagtcactggtgcggtatcccctaatgcgttagttgacgcagtcatcaaggcaggttacggcgcggaagtgattcaggatgaaaccgaacgtcgcgagcgtcagcagcaagttgcacaggccaatatgcgccgtttccgctggcaatcagcttttgccttggccgtcggggttccggtcatggtttggggtatgttgggtgacaatatggtgctcactccctcaaatcacgctatttggctgacgattggtttggtcacactggctgtcatggtgtttgcaggcggccatttttatcgcaatgcgtggcaaagtctgaaaaatggcagtgcaaccatggatacgctggtcgctctgggtacaggcgtcgcctggctctattctatcagcgtcaatttatggccggagatttttccatctcaagcccgtcacctttattatgaagccagcgcgatgattatcggtttaatcaacctcggccatgctctggaacaacgcgcccgtcaacgctcttccaaggcacttgaacgattgctggatttaacccctccgactgcacgggtgatcaccgaaaaaggtgaaaaaacgctgccattggcggatgtgaaacccaacatgatactgcgtctgaccaccggtgatcgcgtacctgtcgatggtgaaattattcagggcaccgtctggctggatgaagctatgctgacaggcgaaccgatcccccaacagaaatcaaccggcgatggcattcatgcaggcacagtcgttcaggatgggacggtgttgttcagagctgctgcggttggcagccagacgacactagcccggatcatcaaactagtgcgccaggcacagagcagtaaaccggaaatcggccaattagcagataaaatatcatcaatatttgttcccgtcgtcattgccatcgcactggtcgctggcgctatctggtatttcatcggccctgctccacaactcatgtactcgctggtcatcatcactaccgtcctgattatcgcctgtccctgcgcccttggattggcgacaccaatgtccattatttctggtgtgggacgagcggcagagttaggagtgctggtgcgtgatgccgatgccctgcaacaagccagtcaactggacacccttgttttcgacaaaacgggtactttgacagaaggcatgccacaagttactgaaataagtacttttaacggattcaccgaagaacaggtattgttatgggctggcgcgttggagagtggctcaaatcatcctctggcaaaggctattgcgctgaaagtggcagggcagaaattgccagaagtacagcaattccgcacattagccggattgggaatacgtggggtggttggagacacaacactgctactggggaatcagagtttgcttgagcaaaatcagattgaaactgcggaattaaaaaccttgatggcgacacaggcagaaaaaggcataactcccgtcatcttggcggctgatggcaaaatcgctgccctgttttccattcgtgatcctctgcgtcaagataccctttctgccctacaacgcttgcatcatcaaggttatcgtttagtcatgctgacgggagataatccggtaacagccaatgctatcgctaaagaagcagggattgatcaggtgattgccggtgtgttacctgatggtaaagcggcagccattcaaacactacaatctgaaggccggaaagtcgccatgatcggtgatggtatcaatgacgcacctgcgctggcacaggcagatgtaagcatcgcaatgggaggtggcagtgatatcgccattgaaacggcggcaattaccctgatgcgccatagcctcaacggtgttgctgatgctgttgcgctttccagaggaacattgcgcaatatgaagcagaacctgtttggcgcatttgtctacaatacattaggcatcccaattgcggcaggtgtcctgtatcccttcacaggaaccttgctaaatcctgtagttgcaggggcagcaatggcgttgtcttcaattacagtcgtcagtaacgctaatcggttattgcgctttaaacccaagcattgaatttcagaataaagtcgacaaaaacttattattcagcccacgaaaagctaaacagaacagagtttagcttttcgtctataacaatcttcccactttcttgttaatctttaacacgttagcatatcgatgagtgccaactattggagtctgtaacatggggaaattgatgacatatctcaacaatgtattaagactgaattcccaacggcattacccctatcctgcttttgacatcaccctgccaaaaaataggcatttgcacattgtgggtagcattcacatgggcacagaaaacatgtttccactttctgagatactactggagcaactggaacagtgtgatgccctcatcgttgaagcggacatcacgcaacccggatctcccttcaaagaaaaatttccagaacaagttgcgctgtcactacgtttatcacctgaacattttgaccgtttaacgcattactgccatgagattcagtatcctctaagatcactggatgcattaccctcatggcaagtcgctttgatattgcaggcagctcaagctcaatatttgggattgcgccctcaatatggcattgactgtcaattgttggatagcgcaaaagccatcgataaggtcattattgagttggaagggacggatactcaggttaacttactctccaacctgccaaatgggggtatttcactgttagaagatacacttacccattggaataccaatgcgcgtgctttacagacgatgattagctggtggatgaattataaacctgcgcagcaaaaccaagcattaccgcagaccttctgcgaagagctccatcagacattgatggccgagcgcaaccatcagtggaatgaacaattacacgctttacccgcaggcaaatatttagttgctgtaggagctctgcatcttcatggtgaaaacaatctgctacagatgatggaaagaatacaaggataaaaactatccttactcgtctcatttttacagagaaattttacaggaaaataggatgacacccgccgttattttactggaaaaacataaaattcacttcaaacttcacccttatgaacatgatacgaatgaacatagtttcggtgatgaagtggttaaaaaactcggtttggatgccaaacaggtttttaaaacactcttggtttcattgaatggcgatcccaaaaatcttgctgtcgcagttacgccggttgcaggacagttggatttgaaaaaagtcgccaaagtcttcaaggctaagaaagcagagatggcagatccccagatggcacaaaaggtgactggctatctggtaggcggcattagcccactagggcaaaaaaaacgtttgcccactgttatcgatagtcaggctcaaatcttgccaaccctatttatttctggaggcaagcgaggattggatattgaattggtgccagccgatttatgccaactacttaattgttcctttgccgatattgctaaagtctgaaaataaattgcaattaccaataaaaggagaaagcaattcattaataactatgatttttaataattatattattatttagtttcaaccattcctattttagataatttaaaatcactcagcataataagtaaagaccacctatcttacaggtggtctttttatacagataactaacgactttcctatcaacgactaccactgatcacttatgaacaatttcacctttcggctcataatcagtagctttcaacggagagtgcttctcgatatagcctttcaacacttcagcatcaacgaaaccggtatccacgtacccaggtaagttatcgacacgtggataaccatcacctccgatagcgttaaagttcagtgtagccatacgataagttttattaagatccaacggcttgccaccaattttcacatcacggatctttttgccatcaaccacaaaactgacattataaaactgcccgtaagcacctgaatccgtctccatatttgccgcagccgtcaaatatggcaagacttcgcgacctttgaaatccacataaaccagttggttggcaaatggatgaactttcaggacatctttgtaagtaatatcccctgcttcgatagaatcacgaatccctcccccactcatcacggcaaaatcagcatttgtccgttccatctgagctgccagtacaagatgcgccatattggtctggatgaaacgcactttactgcgatcaccttctaattttccatctaccacgcccacctgaacatttaatttccggctgcctttatcctgatatggtgtcaacagcttcagcattgcaggattctcagtaatttgatgagtgtaataagctctccctgtgctgccgtcttcgttttttacttttttctgtaagttgatggggatcaattgataatgaaccaatttgaattcaccgttacgaaattggaaatcagcacggccgacatatttgccccattcatgtgcctgcacaatccatgttccattctggcgatctggtgagcaaggtgttcccggtacataatccatttgtttgtagtttttattctctgctgacatacagaccggatcttgtgaatgcccccccacaatcatatttaaataacccgcaggcaaactgcgcgccatttcaacatcccccgcagcattgctgccatgatgcccatcgttatagtgccccatatgggttgcggcaatgatcacatccggtttttcattctttttcagctcatcaataacttttttcgcttcttccgccggtactcggaattcaacatcagggaagttggctgggtttcctacctttgccgtatcatcggttgtcaaaccaataaccgcaattttcacgccttgattatcaaacatcacatacggcttaaataaacgcttgccagtactggtttgataaatgttagcagacagaaatgggaaattggcccatttttcctgctgatgcaacacgtttaaaggtttatcaaactcatgattccccagcgccattgcatcataacccaccaaattcattcccttaaaatctggctcagcatcctgcatatccgattcgggaacaccagtattgatgtcccccccggataacagcaacacactgcctcctttcttggcaacttcctgacggatagaatctaccatcgttttctgagctgccagaccatactcgccatgatcgttctgccaaaagtggccatgatgatcgttagtatgcagaattgtaatatcgtaagttttattcttttcccaagcagctgcacttatcggcaacaatgacaaagaaacgacaagggcacatgctgatgttttgaacgaaaatttcatgggtatctccatgttccttaaatattatctgttatgtaacaattattagttttatgaaaattataaacctatcccatcaagacatgctacttttctacagcagtgtctatataacattatctctgctggaacaggccctaatccaacaccagaatagagtgatgcacctaggtgctaggatatattttccaatcaagattacagaattgtgtcattaattagggttttattttatttttatgggataagtatcaaattatatcaatgtaagtaaaaattttattagcggcctaatatgtattaaagtgtaacaattaaacaacaattcaacgccatacaacacaggctggattgatgggaaaaccaatatgagtgaacaaagcaccacaaaacgattgcctgattcatcaagaaaaacacatcagactgttttttcaattctcggtgcaatcagcttatcccatctgcttaatgatatgattcaatcgctgattttggcgatttatccactattgcaatctgaatttactctgagcttcattcaagttgggatgattacactagtttatcaggtaactgcgtccctgctacaacccctgattggtctgtatacggataaacatccacaaccctactcactgcccatcgggatgggattcactctgtctggattgcttctgctggcttatgccgaaagtttccctatcatcttactggctgcggcactggtcggtacaggatcatccgtctttcatcctgagtcatcacgggttgcgagtatggcctccggaggacgtcatggactggcacaatccctgtttcaggtaggcggcaatctgggaagctcactggggcctctgctggctgcaattttcatcgctccttatggcaagggaaatatcgggtggttttctctggcagcactgctggcgatcgtcattctgttgcaagtcagccaatggtataagatgcagcaccgagcttctaagtttctatcatccactcatatttctcagccgaatttccccagaaaaatgattgtgcgttcttttgccattctgctgctcctgattttctcaaaatatttctatctcaccagtatcagcagttactacactttttatctgatccagaagttcggcctttcagtacaaaatgcccagatccatctgttcatttttttgtttgctgtagctgcaggcactatgattggggggcctatcggagataaaataggccggaaatatgtcatatggggatcaattcttggcgttgcgcccttcactctgcttttaccttatacatcactattctggacggggccccttaccgtagtcattggcctgatattagcatctgcattttctgctattctggtctacgctcaggaacttattcctggcaaaacgggaatgattgcaggtttgttctttgggctggcgttcggcatgggtggtatcggtgcagccgttctcggttatgtagcggataaaaccagtatagagttagtttataaaatctgtgcttttctaccacttcttggtatttttactctattcctgccaaatatagaaataaaaccacaaaaaaaccatgaaaaataacataatgacataattatataattgacatttttctttgtaaacaagcgtaaataatgacaatatctacataaaataccattaaaataccatttatgtagataacctgcatttatacccactagtagctttgttttaaatgatttatacaatacattattacctcatttaaccctaaaatcgatattattgcctaacccagaaggagccttgatggagcattcgacacctcttatcacgaccattgttggcggttttgtactcgcctatctgcttggcatgcttgcccaacgcctgaaaatctcacctctggtgggataccttgcggcaggtgtacttgctgggccttttaccccaggttttgttgccgatacttcgctggcacccgaactttcagaaattggcgtgatcttactgatgtttggtgtcggtctgcatttttcccttaaagatttgttagctgtcaaatcaattgccattccaggcgccatcgctcaaattgcagtcgcaaccttattgggtatgggattatcaacactgcttggctgggggctgtttagcgggatcgtctttggtctctgtctgtccaccgcaagcacagtcgttctgctcagagcgctagaagagcggcaactcattgatagccagcgggggcaaattgctattggctggttgatcgttgaagacctggctatggtactggctctggtattactacccgcagccgcaggtatactggatagccagaatgccaatatcggtcaattgctgttagaacttgctatgaccattggcaaagttgtggccttcattttattgatggtttttgtcggtcgccgtctgattccctggattttggcaaaaacagccagcacaggttcgcgcgagttatttactctggcggtactcgccattgccttaggtgtcgcttacggagccgtgaaactgtttgatgcctcatttgctctgggtgcatttttcgctggtatggtactgaatgagtcagaactgagccatcgggcagcacaggataccttaccgctaagagatgctttcgccgttctgttctttgtctctgtcggaatgttgtttgatccaatggtattgttccagcagccacttgctattctgggaacccttgtcattattattattggcaaatcattggcagctatgcttctggtcaaaatgtttggtcattcacgacgtacagccctgacgatttccgtcagtctcgctcaaatcggggaatttgcctttattctggcagggcttggcgtcactttaggattactggatggagaagcacgtaaccttgtgctggccggtgccattgtctcaattatgttgaatccgattctattcagtttgctggatcgttatctggaaaaaacagaaactattgaagaacaattattagaagaaacgctggaagaagaaactcagatcccagttgatatctgtggccatgccattatcgtgggctatggccgagtcggccgtcttctctgccagcggttgcaagaaagaaatttcccgttggttgtccttgaagatacacgtgcccgatttgaggagttaggggaaatgggcatcagtgcagtgatgggcaatgctgccagcaaagatatcatggctctggcacgactcgattgcgcctgcacgttatttctgactatccccaatggctacgaagcaggtgaaatagttgcgaatgccagagagatccggccagatatcaatattatcgcgcgtgctcactatgatgatgaagtgacctatattatggaacgtggtactaaccacatcattattggtgaacatgaaatagcaagagcgatggctgatgcactcccgacgtctgagccaatttgtccgatagagccaccagcgtcattttcgacagcaagttagttatcgatatggagtatcccgctaaaatcagggggatactccagaataaaccatagcaacgttgttgcatcgttaacgtagtattagcgttcccagtaagattcttccaaactatcttctttctctggcaacccacgcatcaggcgaggtgagtgctggctcaatacctgataactcactctattcgcgtatttacatacctgagccaatgacgagtacgtcaaataagagcgcttatgtttactggagttgggaacattcattcggtggtaactattagctgtaatatcatgtaacaatgcagacaatgcaccatcgccagccccattagtattcatgattttttcaggcccccccatataaggctcaatatgggagtagacccgcattgggttctggcaatcggctttgcatagcacccgactgaattcatagagattaaattcagcgatcgcgcccggtaataatggatgtgaagtctggcgtttatgttcttcttcggtataacctgccatatacagtcccgccggccctgcggtacacaacaccaaatccacccaattcaaggccatatctgctgccagcagaggatcactaaagcccgtcagctcttgggcttcatcttcattcatggcgactaccgaaatattttccgccaaaaaatcgcgccaccactgcggatcatcagcgatgacgtattttgttcccaatgtcagtacaacaggcacattatgctttttcgcatacccgatggctttcatcgttgcttccggcatcggttcacccgatttgcaacgcaccagataggcggtaatcaccagtgctgatgcttccgcaataatatgttcagggatattttccggacggagttggttcattaatcccgggctgatagcgaatgtcctttcaccgttttcagtcaccaaggtaaaacagcggccaattgggccatcaactccctgaagatgattcaaatccatgcggctggatgtattgcagagataacaatatgcataactccctacctggatgctattacacatagtgccaagcaatacggacttatcgtcagccaaaacagaataattatgcagagtattaccgatggttccacccgcaaattcgtgactaatcaaattattgtctgtcagttctttatatagtgcctcggcgacatcatcttcaatgacgagtgaatgcccctggctcaggttataacgctggataaaactctcatcaaccttagcttcaatgtctaccagtgtttgatcgataccaacgatataggctcggttattttcagtatctatcatttctttgatgggctggagtagaggatctctcaggctgacaggaaaatagtgtttagatttacgcttaccagggaatttcataattgattgatgctatagaaccaaaatatgcggcatgttaacacaataccgtagcaaaacaaaaaacgtagcgccataacgaacaacagccaatgctattgcagcattggctgtcaaacgttaacgagcaaagcgctgacgataaaaagtttaagcttcttgtttctggcggccgcgcgccatatggcgaaccagaacaaacataacagataaaataaagccaataaaaccagcaccaatcagaatcagcagacgcttaggtgaatctttcgctgtaggttcataaggttgctgcatatacctgaatggctcgaaatcaatcttattaatattcactgcttttaaattttctatatataaaagtctgttacgaagatctgcatctatctgggtcggatcggtaatctcttcagtaatctgcaatttacgttgcagtgcatccgcacccagcgcaatcgaataatccgggtcatccttgatcatagcgccgccattggaaacaggttttttaacaccggcagagttagcaatggagatcgcatacttcaagcgttcgatatcaacaccacgcatatttctgatgcgagccagatcaatttcatacgacttttgtgaaaagaccagtttctgatgcaccatatcattcaattcatctttcacctgatcacgaacaacggaagagacaaaattgatatacccagtcaacaagttgtaagaatcttccgcagtacccgcactgaaagagagtatgctttcgtcatcttcttcattatcttttttaggtaaagaaatggagatgtttttatttacaacctgctcaataagctttcgtttgccctgtatcgcaccatcgtccatcttagcaagcaacgccttgaagtaatcagtgctgaccaaataatcttcacgcaatacacgcgagttatagttttcgacaaaacgctgatataacgatgcttctgtcactttcggatcaagactcaaaacttgcaaatccgtgagtgcatttttcaatggctgaaattgttccaatgtcggcttcactacggctgctgtacttgtccatttctgtggtaaaaatgacgcaatactgaagccaatcaccgcaaaaaccacggatattgcgataattaaatattttgattggaaaattacggaaaataattcaaataaatcaatctcatcttcctgtttagggtgataatagtttgaattttcttcataaaaatcagggtgtttaatcggtttattactcattatctctatgcccaatccaaataattttgcttttcattaagactcaagttgtttttcttactcatagtattcattgattttaaagcaatacccttaaaaatcacacgatcaccaaaacacgtgctgataaatataccaccaaaatacccatagctaccaatactcgccagtcaaaatgtaaaataacatctcataacagacaataatccttatttcatggcgttatttaccaattgttcaagcaatgaaatgtgtgcctcattatcattaagtgcagaaatatattcaaactttttacccccggcatgccggaaaatcgcttgattttgctgttggatttcttccagtgtttccaaacagtctgatgaaaatcccggacacagtacctgaacatgttccacaccttgttctggcaataatgccattgtcttatccgtatagggcgttaaccacggcaaacgaccaaaacgagattgaaaagtcatcataattttatctgcaggataatccaatgcctgtatcaaaagctccgtagttgccctgcaatcctgcggataaatatcacctatcgttgccaaccgttctggaataccgtggtaggaaagaagcaaacgatcaggcaaaccatgtttttcaaaactcttctcgattgtttcttttaaggcagcaatataagcaggatgtgtagcatagctacggatgaaatacaaatggggtatggtacgatatcccttcaatattttgctgatgctatcaaataccgcagccgatgtcgtactggaatactgaggataaagaggaagcacaatcaggtggtcaataccttgttgcagaagattaccgacagcttggggcaaggaaggaaaaccgtaactcattcccaaaacgacggggatatccgtcaatctttcatttagcaatttctgctggcgctgactataaaccagcaaaggtgatccctcgtctgtccaaatttcttggtacagcttagcaacacgagaagaacggaaaggaagaataatgccgtacaacagcggtttccagataaacgaagggatatccacaactcttcggtcactcagaaatttcgccagataacgccttattgctacaggtgttggctcatccggcgtcccaagattcaccagtaagacaccatacttattgctactcatccctcagtactccactaaaataactaataacctagtataaacatgagttatagtcacatctaacatttcatggagtgacattcaaaaaaatcaggcggttattaacaccgcctgctctagctgttcaagatttaataattcaagaacataccaagtcattagcccagaatgccgaccaattcttcgctgacttcagctacctgacgtgtaccatcaagtttggagtactttgtgttccctgcctgagcttcgttctgatagtaagaaaccaaaggtgcagtctgtgcgtggtattcaaccagacgtttacgtactgtatcttcctgatcatctttacgaatactcagttcttcaccagtcacatcatcccggttttctactttgggctgattaaatttgatgtgataaacacgacccgatggcgcgtgtacacgacggccaataatgcgttcaacaatgattgcatcaggaacagcgaattccagaacataatcaaccttgatacccgcttctttcatcgcatcagcctgaggaatggtacgtgggaacccatccaacaagaatccactacggcagtcatcttgtttgatacgctctttgaccaaagcaatgaccagttcatcagtcaccagcttaccgttgtccatcagttcttttgctttcaaacccaactcgctgcctgcttttactgcggcacgcaacatatcacctgtcgaaatctgagggatcccatatttctccatgataaattgcgcctgagtccccttaccggcgcctggcgcgcccagcaaaataatacgcatcgcgtaaatccccttgctatttgcttttcgtattttaaataaaacgagccaccataccatttgaatagggtatggctcaagaaaacaggtaaacgttttcgtattgacctaaaaataaaccacgcccaattttacgttgaagcgtggtctattatcatgatttcaatgagtttaagctttttcagccaataataattgattcatccggcgaatgaattggtttggatcatctaatgtgccgcgttcagcaaacaatgcctgatccagtaacagttctatccaatccgcaaactgagcttcatcaggaatatcagccgcttttttcactagattgtgttctggattcagttcaaagttatagctcacttctggtgcagactgtcctgctgccgcaaatagtttcgccatttgggtgctcatttcattggcattcgttgtcactatcgcgggtgtatcagtcagtctgtgggtcagcttaacttctttcacacggtcaccaagcagcgttttcacacgctcaataaacggctccagttttttatcttcttcttcctgctcggctttgttttcatcagccagtttgtcaagagattcatccgtcttgctgacagactggaatgacttgccatcaaactcggtcaggtagctcatcatccattcatcgatacggtcagacagcaacagaacttcaatgcctttcttgcggaacagctccagatgtgggctattttttgctgcggcgtagctgtcggcagtaatgtagtaaatcttctcctgaccttcagtcatgcggctgaggtaatcttccagagaaacagtttgtgccgagccatcatgatgagtggttgcgaatcgcagtaatttagcaatagcttctttgtttgaaccgtcttcagcaggcccttctttcagtaccaagccaaactgctgccagaaggtctggtatttttccgcatcgtcttttgctaatttatccagcatctgcaatacacgtttggtcaacgcattacgcaaattgcgggtgatagtactgtcttgcagaatttcacgggaaacgttcagcggcaagtcattggaatcgatcagaccacgcataaaacgcagataatttggcatgaactgttcggcatcatccatgatgaatacgcgttgtacatacaatttcagcccatgtttatgttcacggttccacatatcccacggtgcctgagcagggatatacaacaagctggtgtattcctgtttaccttcaacgcgattgtggctccagctcagaggatcagtgaaatcatgggaaatgtgtttataaaactcttggtattcttcatcactgatttcggctttaccacgtgtccacagcgcttgagctttattgattttttcccatgtgacggtatcgtcttcttcgtttttggtttcaatttcaactggcaacgcaatgtgatcagaatatttaccgatgatagaacgcagacgccagtcgttaagaaattcatcttccccttcacgcagatgcaaagtgatttctgtaccacgctcagttttttcaagatcagcaatggtgtaatcaccttcacctgttgattcccagaaaacaccttgatcggccgcagtgcctgccgcacgggtacgcacagtcactttatccgccacgataaaggcagagtaaaaaccaacgccgaattgcccaatcaactggctgtcttttacctgatcagaaccaacagattcaaggaatgatttagtaccggattttgcaatcgttcccagattatcaataacttcatcacgggacatgccgataccattatcactgatagtgatggttttatgctcgttatcaaaagcaagacgaacacgtaactcaccatcattttcatacaattcaggttttgacaatgcacggaagcgtaatttatccgcagcatctgatgcatttgaaatcaactcacggagaaaaatttctttattggaatagagagaatggatcatcaactgcaatagttgtttgacttcagactgaaatccacgggtttcctgacctttcatgctcatttattacctcaatctaaatccagttcagatatgtaaaatcggacgatggtaatcagatggggataactcccaacaatttcaagttagggcaatcagaagaatataaaattggtttgatgaatgtacaaatcagctatggatggtggcgttatccgcaacaccatccattggaatttcccatttgaaattgggtaatcgatcacaaatcagtgattctttgacgacccgcaagtgaatgggacaacgttgtaccatccaccatttcaagttccccccccacgggaacaccatgagcaatacgactggctatcacaccatattgcgaacacatttccgcgatatagtttgccgttgcctctccttcaacagtcgggttggtggccagaataatttctgacagggtttcggaagacagacgttcttccaaacgatccaaaccaatatccattggcccgataccatccagcggcgataagcgccccatcaggacaaaataacgaccggcaaactggccggtctgttcaatggcgtgaatatccgcaggcgtttccaccacacagatctgaccattctgctgacgacggggattaccacaaatcgtgcattgttcctgttcagtaaatgtccggcagtcctgacagtgaccaatttcagacattgcacgagtcaatgcctgagcaagcctcatgccaccactgcgatcccgttgcaacaaatgaaatgccattcgctgggctgatttgggacctacaccgggtaaacagcgtaatgactccatcagggattcaagaagaggactggtttgcatcagaatggcatcttaaagccaggcggtaattgcatgccgttagaaacgccggacattttttctttctgggtttcttcaattcgacgggctgcatcattgaatgcagcggcaatcaggtcttccagcatatctttgtcatcgtccatcaagcttggatcgatttcaacacgacgacagttgtgtgcaccattaatagtcactttcaccagacccgcaccagattcacctgtcacttccaaatttgcaatttcttcctgcactttctgcattttttcttgcatctgctgggcctgtttcatcagattgcccaaaccacctttaccaaacataattatctctcttcgctatagccacagtttaaatacacaccgtagcagttaaacaggccggatactttcttcatccaattctgcatcaaacagctgctgaagtgtttgaatcgttctatccgaaataatggattggcgtgcttgtgccaatttttcttcataaatggcttgccgccactccaacggagtttttaccgcaggattatcatcttcaataatacggagttcaataggttttccatgcaattcacttaaggcttcggacaacatttgctgtgccgatgctgaattaaggtgacgttgtttggaacgcagatgaagacaaaaccgactttcatcaatctgttctttaaacgcattcaatgcaacttgctgaaccagttttggaatattcagtttatcaatttccgctgaccatgaatctctctgtttcgattcaaccgccaacttttccgccagttctggtgtcttttcgtgctcaagtgctgcttttatcgcttttggtgtcgtgacacaaaccggcttttcctcaatactcgtattcgttgtccgccagcggtaagcttcttgctttatgggctttggctcctgggctttgggaatataagattgtgaccgctgttcggccacggctgctaatcgttccagcgccgagcttgccgacttcgccttcacaggctctgccggctcagacttttttgggggcgtattcccttgtcgagtaagcgaatgcctcgcttgcagcaattttgccgttggactgctgattacaggttctgtactcatcgattgcggagaactgtgttcagaaccattctcagagcgttcaccagccacatggttttgtacaggtgaaaccggatggcgttgtgcagatgcagatacctgcggtactaccgggatttctccacctgacgctggcgtttcttcaatgatagttttggggtggaacgccaaagcgcgtaataatgccatttcaacacccattcggcgctctggggcataagggagatctttgcgtccgaccagcaatgcctgataaaaaagttgtagatcggcaggagaaattgatcttgccagcaaccgcaaacgcccttccattgaagagggatcattatcaggttgctgaggcaacaactggagcatggcaatgcgatgcagtaatgacaaaatgtcaaccaacagatgttcccaatccacgccacgggatgcgatttgctcaaccagcgccataagctgttgcccatcagcccgaaccagccattcaatcatttccaaaggctgatcattatccagcgtgcctaacatctggctaacgatatcggcggtcagtttacctccaccgagggcaatcgcctgatcggtcaggctcagagcatcacgcatactaccatccgcagcacgggccagaagatggcgcgcacgggagtcgctctctatttgctctgcattaaggacatgttccaactgaccactgatttgatcaacattcaatgctttcagatggaattgtagacaacgtgaaaggatcgtcacgggcagtttttgtggatctgttgtcgccagcaagaatttcacatgttcaggcggttcttccaatgtcttgagtaacgcattgaaactatggcgcgaaagcatgtgaacttcgtcaatgagataaactttgaaacggccacgggcaggtgcatactgcacgttgtccagtaattcacgggtatcttctacttttgttcgagaggcggcatcgatttcgatcagatcgacaaaacgcccctgctcaatttcaagacagttcgcacattgaccacatggggtcttcgtgattcccgtttcacagttcagcccctttgccaacagacgtgcgatggtggtttttcccacaccacgggtgccagaaaaaagataggcatgatggaggcgctggtgctcaagaccattcgccagtgcagtcagcacatgttgctgaccaatcacatcagaaaatatttgtgggcgccacttacgggcgagtacctgatagctcatgaataccgaggaaattgaacatgactgagtatcatgctagcacagcctcaccatgaacggcgaggctgatgtatcaattatgcaaaaatgggagtaatcagtgaccagggaactctatgagcgtgtagctctcgataccctgttttttcaaacgctcggtaccgcctaaatcaggcaggccaatgatgaatgccgcttcagaaacttctccacccagacgtcgaatcaaacttacggtcgcctcaatggtaccgcctgttgcaagaagatcatcaaccaccagaactttatccccttctttgatactgtttttatggatttccaaggtatcagtaccatattccagatcgtaagtttcacttaacgtcgcacgaggtaatttgcctttcttgcgaacgggaataaaaccaactcccagacgtagtgcaacaggggcgccaaacaagaaaccacgagcttctgtaccaacgattttggtaatgcctttctcttgataatgtattaccagtagatcaatcgtagcttggtaggcaacgggattatccagcagcgtggtgatgtcacgaaaaagtaccccgacttttgggtaatcagggatcgtttcgatactatctttaataaattgtagtttttgcgcattagcggtcataatcgatgccagccagttataaaaaacgaaaacgctaaaatctattcaaactatgggaaaaaagcaaccgcaaagcaaattgcagcctgtttttgttgattttggtcaagcttggcacctatcacatcaagcattattgttacaaaatagttaagcatgatgaagtaggttttaacgaagatattattaacgataacggaatgctgatgagtatacaaaatttattagtcgcacttgaaaaacagatcagtatgctggaaacagagcttgaatcactccccaaaacacctttttcaatcgcccgttttgatcaagcattattccaccaacacagcaataaactaggtggatatcttaatgaaattaaaaaaaatatgtcacaattaaagacctgtgtgaaagataatcgtaccgagcaggtcagatttctttctgaacgtttagtgacgcaaattgaagcactgaaacgcgaaatatcaacacagtcactgagaaagcaagaggataaatttgaacgtcagtcgcaagaacgggatttttaccatcgtctggctgaacatcaggattatgagcgccgtttaatggcaatgattaatgatcgggaattacagttaaataaacaagttataccgacaaaccaatataaactacaaaaagaaatcgcagcgctggcaggaaggctcgctcgctgtcgccaagcattgatgcgtatcgaaaaagcgatagaaaagcaagaaaattcagattagtcactaaggagcataaccgattatggatctcgaacaagcaccacctgaagtgcaactcgcggtagatctgatttatttactcgaatgcaatgaaatttctcccgatatcgcactagctgcgttaaagatcgtcaaagacgattttcaagaaaaactgaaaaaacaagctcagcagcctgaggaatgaacagagttaatgcctatcccatcaaacatgtcttttaaggtaaaagtggctgatcgccaggagataccttcccatctggatggtggctaccaccgttcaatgacttctgtacctcttgcagactattgccttgcccattgtgcaaatacacttccaactggttgaatgcgatattgatatcattttcccgacatagtttatcaatattgcggttaacttcatccacagtatggctacgatcgcccaactctttcacatatagcctcaattcatgatccaatgtactggcaccaaaactcataaaataaacctgtggtattggttcattcataacacgagggttatctttggccgctttaagcagaacttctttcaccttatccagatctgagccatacgcaacgccaactttaatgataatacgtgtgatagtgtcagaaagtgtccaattgatcagacgctccgtaacaaaagcacgattgggaataatcacttctttacggtcaaaatctgtaattgttgtcgccctgatgcggattttactgactgagccagagtaagtgcctatcgtcacagtatctccaatacgaacaggacgttcgaacaaaatgatcagacctgatacgaaattggcaaaaatttcctgtaaaccaaaacctaaaccgactgaaagagccgccgccaaccactgtaatttattccacgaaagccccaatgttcccaatgcactgattccaccgacgccaatgatcaggtaagtcagagtcgtcttaatcgcataagaagaaccctgttgtagctgtaaacgagacaataccaacacttctaataagcccggcaagtttctcatcattacccatgaaatcaccagcgttgccatagaaatccccagatctttcaaggtaacctgttgcaggacactccccagctctgttgtcgtgctgtactgccacagattaatcccatcaaggtaggaaaatactgtcactaaatcagaccaaacccagtaaaaggcgcccaaaaaaatcaaaaacagcaccatcgtggttaaacgcaatgattgctggttaatgcgcttcagctccattggcggctcttccattacgtctccttctgccccttctttcgcctgagcctgacgccgggaaattgcccggcgataggcaatgcggcgggcggcaattcccaatccccgtaaacaagcctgataacagatatgccagaggaacagcaggtaaaggctgtaaagccaacgttcagccaaacgcagggttgtatagaaataaccggataccataagcaccatcagaaccagaggtgcaaaagtcaatgtcgtcaccaccatggttcggatcatgtgtgaacttttcacatgccataaccgacggcagaatggaaaaataaaaatgaaaacgaagagcaggcaaattaacaccgtgcactgaccaatcacatcatcagataaacgtaacgggtgtttgacccctaaagttatccaaaacagtatcggcagcaatacaatcgataaccgcacaagatttttgcggaacagagtgtaatccgcgctgttcaatgaaaaatggtgctctcctattccacctttggcgaggatttggtaactacatcgatacatagtccagaaaagcgccaattgtcgagaaaagctccatattaaatcacctaaatcatcccctgatttcgaataccagtagcctatagccaaaattataagagcaagtggtaatgtttttaccaatgtcagaattaatgctaatggggtatgcaactggctgtcccgatgcagttgccctacctcatcagaaattttcttcaactgctcattaatgccttttgtctgccagcgtaaaaacaggccgaccagcaaaaggggaatgacaaagtgaatggaattctttaatcccgtggcaagtccactgagagtcaaatgaatattcagatggctcagctcttcctgaattaaatcaggcaaagatttcaaccaagccaggttcattggtttattgctgttgacccagaagatctgttggacaagcgtctgttccaacgactggctgacatccagcaattgttgctgatccatctgtaaattgatggcgtgtgtaatttgatttcccaactggttattgagttgattcaaaagctcacggcgaatttccagaatttgttcgatagcattacgaatttcacctactgcttccttagattcatgttttatctcatctgaatgtaggttcaataactgattgacataatcattaaactggtaaagcttatcgcgttgctggttaatttcaaattgctccaaacgcagatcagcaatttttatcggcaaatcctttgtcagtacattttgcggtaccttgagctgttcctgaaacaggatacgcgacagcaataaactgccacgtaatactttaacctgctctttaagattacgttcagattggatggctctatccaagaaattcttaacgagaatatttttttgtaccagttggttactttcccgcgtttcggcaatcagccgctcactgagttcgcgattgatctggatttcttccttaaccaacgggttagactgaatatgagaattagtatcgtctgaattctgtgcttcttttgctgtttcttcagaaacaatcaaacgctttccgctcaccacattttgaataaattgaacataacgttctaactgatcaatttggaaagaagtgtaatcacgttgctgttgcaaaagcgtctgtagttgtgtgtttgcctgtagggatgtcctttgcaactcattttgctgcatcagaaaagattgttctacccgcagcaaatcaagctgggggtaacgtgattccggctgttctgtcagctcattattgagttgattacggatttgttgcagtctttgcacattgtggaacagtaaattttgcgcccgttccggctgggtttgcagcccaattaactggctattatagctagcaaggttttcctgagctcgttgcaagctattcagtgtactgttcagtttggattcaagttgcttcagcgacaacgtttccagcgtttgtttataatcattctcatcctgctgggcgttattcttcagattttccaatccgaccgtgatttgacgtgatttctgcggagaatcctgtaagttttttttaagtaaatcggaatccagattaacttgatctattttgtcaaagaaatagagtgccttttccaaatcagctatcgatgttttctcctcaaccgtgtgttccttacgttctgtcaggatcttaagctgattttgaatatcattgcgggttggtatttcactgctaaatgttgccattgcaggagaaaagaaaaataacagaaggaaaaacaggctcaccatgaaaacaaaacgaaaatgtaatgcatcaggccttttatcgcataagacccacttattgagcaaaatacccaagtatcggttaaatggaaccataaattcatctactcatcatttgcagataatggaatgatagcgctgaatatcaggaggttctgaccgagtttatggttcaaactttcctaataacgtcaatttaaaatgataacactaagaatagattccatcgacattcgctcctgtgatttaaaacttattttcctcgttacatcgcaagtggtggctatatttgagtgtatcaatgagactatccaccagatgcgtcgattgttccttaagattaaaactgtctggtgcgaatgaccagttttccaatactcctgtcaccaacgctttcagcatgatggcagaacgcctgagatcgagatcatgaggtaattctcccgactgaatacaagcctccaaaatattttcaatttttttataatcggaaatacataatcctctaagcttctcagccaataaaagcatttctccaacaaactcacatttgtggaaaaaaatttccatcagtaatcgatttctggaatcatcaatcatcatttttaacagaaaaatcaacagagatctcaatgcaaggagtggattattcggatattttgcttgatactctttctctaactcgtcgattttattttcgtgcattttacaaacagcagaaatcagatcgattttgtttttgaaatgccaataaattgcgccacgcgtcacactggctgcaatcgcgatatctgacaatgaagtagcagaaactccacgttcagaaaatacctttatcgcggcttctataatctgttggcgggtttcttttgctttctgtttagtttttcgtgccattttcgtgccataaactttatttttgacttgaggatgatttacatacattcatgtatgtttgtactatagcactctcaatcaataaagtaataatttcactcgttagcactagctagattttaaagcgtctacattgaaaaattgaggtttacttatgcgaaaaaacagaggggttttgcctctggccacactactggtactttcaggcagcttcattctctcaggatgtaatgacaacaaaaattctcagcaaggggctgctggcgagcatgcttctgaagtgggtattgtaacgctgaaagcagaacctctggctgttatcacagaattacctgggcggacttctgcttatcgtgttgcggaagttcgtcctcaagtcagtggcatcattctgaaacgtaactataaagaaggtagtgatattgccgcaggtgagtcgttataccagatagatccagcaacctatcaggcagactacaacaaagccttggcaaatttatctcgggtacaagccaatgagaaagtgtctcgtttaaccgttgaccgttataaatcattactgggtacacaatatgtgagtaagcaggaatttgataaagtaatttctgcacatgctcaggcagccgcagaagtgctgtctaccaaagctgagctggaaagtaccagaatcaatctagcgtatactaaagtgacctcacccatttctgggcgtgcgggtaaatccactgtcactgaaggagcgctggtttctggtgggcagccaaccgccttgacaacggttcaacaactgaaccctatctatgttgatattacccaatcaagcgatgattatttacgtctaaaaaatgaaatagccaaaggaacagttcataaagaaggcggtaaaaccaaaactcgcctaatcactgatacaggtaaagagtacagtcaggaaggctaccttgagttttccgatattacagttgatgaaacaaccggctctatcactatgcgtgcggttttcccaaatcccaatgaagaactacttcctggcatgtttgtccgtacaaaactggaagaaggcgttcgacaaaatgcgattttggttcctcagcaagcaattaccagaacacctcgtggccaggcaaccacgctgattgtcgataaggataacaaagtagaattacgtagtatcaatgctgttcaggcaatcggtaataagtggctggtcacagaaggtttgaaagccggagatagagtgatagtcacaggattgcagaaaattgctccaggagtcaccgttaaaccaatggaaactaatctggatgctaagctcacagccaatcaaactgagcctgctaaaaagcctcaataaaggagttggtgattcatgcctaagttttttatagatcgaccaatctttgcatgggtaattgcgattatcaccatgctttctggtctattggcgataatgaaattacccgtggagcaataccctgcaattgcaccaccttctatttccatttctgcggtttatccaggagctgacgcaacaacggtacaaaacacggtaacccagattattgaacaaaatatgaacggtatcgataatctggtatacatggcttccaacagtgattctgctgggcgtatgagcattacgctaacttttgaagcgaacacagatccagatatcgcccaagtacaggtacagaataaactgcaactggcaatgcccctattgcctcgggaagttcaacaacaaggtattagtgttgataaaacaactaattcattcttaatggtggcaggtttcatttctgaagatggttccatgactcaggatgatatcgctgattatgttggagccagtgtcaaagacccattgagccgtgtcagtggtgtgggtgaaacgatgttgtttggtaaccagtatgctatgcgcatttggctcgatcctgacaaactgctcaactataaaatgaccacacaggatgtcatcactgccattaaagctcaaaacaaccaagttgcagccgggcagttaggaggaaccccgcctgttcctggacagcgtttaaatgcttcgattattgctcagacccgtctgaattctcctgaagaattcagcaatattctgctgcgcatgaatcgcgatggttcacacattcgcctgagagatgtctctgtcgttgaacttggagctgaaagctacagcatcattggtcggttcaatggtaactcggcagcaggaattggtatcaaactggctaccggcgccaacgcgttagatacctcaaaagccgtcaaaaaagccctggctgagatggcaccattcttcccacatgggttgactgtcgtgtatccatacgacactacgccattcgtcaaaatttccattttcgaagtggtgaaaacgttggcagaagccatcctgctggtgtttgtcgtcatgtacctgttcctgcaaaacttccgcgccactttaatcccaactattgcggttccggttgtattgctgggtacatttgccatccttgccgcatttggttactccatcaatacattaaccatgtttgccatggtacttgccatcggtctgctggtggatgatgccattgttgtcgtggagaacgtcgaacgcgtcatgcaggaggaagggttaccaccaaaagaagccaccagaaaatcaatgggacagattcagagcgctctggtcggtatcgcgttggtactttctgcggtatttgtgccaatggcattcttcggtggagcaacaggcgcaatttatcgtcagttctcgatcaccattgtttcagcaatggtactgtctgtactggtggcgttaatcctgactcccgcactgtgtgccacaatgcttaaacccgttgctaaaggtagccatggcattcaaattggtttctttggctggtttaatcgcctgtttgaaaagagcacccaccattataccgatagtgtaggccgcatgctgcgtggtactggacgctacttgttgatctatgttgtattgatcgcaggtatggcctttatgtttacccgtatgccatcttccttcctgccagaagaagatcagggtgtattacttgcgatagttcagctaccacctggttcaactcaggatcaaacacaaaaagtattggatgaaatcaatgattacttccataccaaagaaacggaaattgttaaatctgtattcaccattaacggttttagtttcagtggtcaggggcagaatgcaggtctagtctttgtcagcttaaaagactgggatgagcgcaaagacgacaaagacaaggtgccagccattgttgaccgtgcgaatgcacatttctcacaaatcaaggaaggtatcgtatttgcgtttaatattccttcgattgtggagttagggtctgccagtggttttgacttccaattgattgataaagggaatcttggacatgaagcattaacccaagcacgtaaccagttgcttggcatggttcaaagccaccctgacatgctcacgaatgtccgccctaatggtcagaatgatacgcctcaataccgtatccatatagataaagagaaagcggaagcactgggcgtttccaccgaaaacatcaactcaacactcactacgatgtttggtggagcttatgtcaatgactttattgaccgtggccgagtcaaaaaagtctatattcagtctgatgcacctcaccgtatgttgccaagcgatatcagtaagttatatgcccgcaaccaccatggtgaaatggttccgttctctgcattcatagacatatccaaagatccgtgggtttatggttcaccgcgcttggaacgctataacggtttgccatcaatggaaatcgtgggtgaggctgttaaagggaaaagtaccggggatgcaatggttttcatggaacaacttgcgtcacaactgccaagcggcattggctatgactggactggcatgtcttatcaagagcgtctatccggcaatcaggctccagctctatatacgctatcattgattgtcgtgttcctctgtctggcagctctgtatgaaagctggtccattccattctctgtcatgttagttgtcccgctgggaattgttggtgcattgctggcaacgtcaattcgtgggttggacaatgacgtctactttaaagttggtctgttgacaacaataggtctgtcagcgaaaaacgccatacttatcgtagaattcgccaaggatctgatagagaaagaaggcaaagggctaatagaagcaactctagatgctgtcaaaatgcgtttacgcccaatactgatgacttctttagcctttatgcttggagttatgcctctagtattgagtaatggtgctggctctggtgcacaaaacgccgtagggacaggcgtattgggcggtatgattgcagctacatcgttagcaatctattttgtcccagtattcttcgtcgtcatcaaacgccgtttcagtaaaaaaagtgaggatctcgaacatatttcgacccatcgctaaattcaaaaattttaaccaaaggccactgatgtggccttttaaaatgggcttaaatctcttcagacaacaaataatcaatctctcaatatctacaacgacaaccttatataatctaattaaaataaatacttatgaaaaacaccctgcgtttaaaagtaatatctttctgttttttataataaatagaagataaattaatagcttgtcatgcttttcttctgattacacctctaatggtaaaaagtgttccatcttgatggtgacatatgtaataatagcattatattgattttgaaagtcgcaatacaatcacctataatgatcccagtgctattgctacaacgtctactatattagtataatccaatatgtttaatgacatatgtgaatatcgctatactttttagtagagtgctagtcttttgccagaactaagtgtaagttggtcatcgttaaaaactcacttggcagatgctagaaataggtctttaatattaataaataataatcatgttttgataggccatattctaaaagaatggctataataattgttatgtataagccttaatccaaataagccgtgtgttgttacagaggtgattatggatgaatattcaccaagaagacatgatattgttgaattaaaatacttatgtgaaaatttaattcacgaggcattttcagtgctaaatcgcgctgataatcattggattaacgatctgacttccgaaaaaagcttaaaactaaatgaattgatcgagcacattgcagcgttcgtctggagttttaaaattaaatacgcagataactacaatctcagtaccttaattgataaatacctggatgaaacatataatttgttcgggagtgataagataagctgttttgaacttacaaaatggcaaaaaacaaacgaacacttaactaacattctgttgcatgatttgaatgcctgtttaagcaaaacctgataaatatattcctaactatttttttataccaaataagataaggcaaccatgactaaaactgactatctgatgcgtttgagaaaatgcacttctattgaaacactggaacgtgtaattgaaaaaaataaatatgagctttcggatgatgaacttgaattgttctactctgctgctgaccaccgcttagctgaacttactatgaataagctttatgataagatcccatcatctgtttggaaatttgtccgctaagttgtcgtgatcagataggaagtaattgaagccggtaaccattatcggctcactatataaacagattatgaattcaaaacgggtgagggctctgccagcgacatcccggcacacacatcccctgctatggctgcttctttccagatctgaccaagttaacaagttagcgttgcgggagaaccaacagagcccccattgaaattagcttcaaacctcaaagcggtaggcattatctttcatacatcgtgaaatagcaaggccgcgccattcagatgcttacttatcactcaattagatgtaaaaaaacatcaaaaatgtcactaacgaactaaaattgacacaaactcaaagacttttatttttccacaatcaaataacttttctaagtaaaatgttgttgttctgcttatcagtgttatgttcgatttcttcaacctcgtaaaaacccacgacaatcctgctactatggcaaatcaggcatttagcataaaaaccatcaataagcaaaatataaatatactaaataatcaaaaaaaataatttttcaatcataaataaatttttattaaatctaaaaatccaacacatataaatcataaattcgttcttcaatgaaccacgaaaataaaaataagcataaaaatcaatgataaaaacaataacaatatcatactcatgatttgataagcgttgaaaaaattaatagtgataattcaatttcataacaaaaacataaagataaattttatctacaattcagtctatttatttactaataaatgaaaatttattattgctccttaatgtaccgttgttgctttatacgtttttaaccgctattaccaagcgaaggcacattatgagttaggcattacaaaatttaattaacctgatacatctggagaacgtggttttgttcgtggacatatctatacccgtgaagaaatactcatcgcttatgccattcaggaaggggtgagccgcaaacgaaaataatatcgtgtgccgtagatatagtatggcacacgacagtttcaaagatagaagatatgatcagttataagcactttcaccatgagaaataatatccaagccttccctttccgactcaacgctaatacgcaacccagccaccagatcagcaatcttgaatgacagataagcagccacagctgaccagacaatacaaaccaatatactaatgatctgcacgccgatctgtcttagcattgtcataccttctggaaatccagttccccctaaagcggatgcagtgaaaatactcgttaataaacacccaacaatgccacatacgccatgtactccaaaaacatcacagacatcatcaacacgtaaccagcgttttaataccaccacgccccataaaccggcaactccagcaatcagtccaatgataagcgcaccaccgataccaactgttgccgctgcgggtgtaattgccaccaaacccgcaatacaaccagaacatgctcccaaaagagaaggcttatcacggaatagccattcagaaaaaacccatgacaataccgcacctgctgttgctgccatcgtatttataagggctagcgctgcgatggcatttacagcaccagcagaaccaacattaaaaccaaaccagccaatgtaaaggatcgcagtgccaataaaagtcattggcaagttatgaggcttaaaagcttccttaccaaatcctgagcgctttccaagtaaataagcaccaaccaatcctgcaaccgctgcgttaatatgaacgacagttcctcccgcaaaatctaatgcaccatcctgagcaagccagcctcctccccacaccatatgcgccataggaatataggaagctgtcagccataacgcactaaaaattaacagtgcagaaaaacgaactctttcacataaagccccgacaaccaaggctatggtgatacaggcaaatgccccctgaaaaacgacatgaatcagttgataaaaactgccattcaaatcagttatcgatatatttttcagcatgacttgctcaaatccaccccaaaaacgattgcctgtttcaaaggtcatgctataaccgtaaactacccaaagtacacagactaatgaaaagctaacaatcacctgtgacattaatgacaaaacattcttacgacgcagcaatcctccataaaacagagctatgccaggtatagtcataaagagcacaagtaccgtatttaccagcatgaatacagtatcagctttatcgaaagtacttcccgcagcaaacgcaaaagaaggtacactagcgataatccccatagtgatgctggttatggataaaagtcgttttttcattttccatccccccatttacaatgctgcatcattcgtttcccccgttctgatacggacagcatgctgtaattcaaagataaatatcttgccatcccccatttttccagtgaatgcagattgctgtatgacatggataacttcttctactcgctcatcatgggtagcaatatcaattttaactttgggtaaaaaattaacgttgtattcggctccccgataaagttctgagtgccccttttgacgtccaaatccctttacttctgtaaccgtcattccttgtataccaatatcggaaagcgcttcacgcacttcttctaacttaaatggctttatgatggtagtaatcagtttcatacttcccccgctttttgctgtgtttgcaaggaacattcgcgcgagaagtattgcaaggggtatgccaagagttaaaaagtatctgtaatcaatttgttatcagagaacatagctgggaaaggaaagtaaaaaaggagtgactagagcagtcactccttttatgcacactaaacgtgcatagattcattcaaaatatcaccgacctgttggagttgatacatctgataatagcgtccacgtttagccagtagctgttgatgctgcccttgctccactattgcaccacgatgtagcactaatatggaatctgcttcaacaatagttgaaagacgatgggcgatgaccaccagagtcgtctgtttacggatcatccgcaatgcctgctgtaccgattgctccgtccccgaatcaatattcgccgttgcttcatccaagatgagaatctgcggcgtttgcaccaggactcgagccattgctaaaagttgtttttgccctgcggaaagagtattcccctgctctcctagtactgaattcagaccatctggtaagcggcggacaaaatcagccaattgaaccatctccaacacctgccaaattttatcttcactgatatcccgccccaatgtgatgttgtcgaaaaatgaggctgcaagcactacaggatcttgctgtaccattgctacgccattacgcagaaccgcatgagagagggaagatacaggacgaccatcaagataaatttcaccgtcttgccacggataatatcccataatcaaattagtcagagtacttttaccacttcccgtatgaccaaccaaagccacaaacccatgtgtaggaacatgtagattgatgtcactcaacacaactttgtcattacgataggcaaaagttaagttttcaatatcaattctaccactcatcagcgcctgctgatcagtgccatattgctgctgtgggctatccattaactcaaaaacccgttcccctgaaactaccgcttgttgcagtaaagattgttgagcagtcagttcaatcagaggttcattcaggcgcccaagataattgacgaatgcgtataaaacacccacaccaatcacttccgttcctttgaaaccaaataacaatagcaggccacacagtatggcagcagaaaacaaactcagtaacggcctcagcaaaatgccatccaaccgcaacgcttgcatgcgagactgataatgttcacgattagtcgccagcattttctcaccaaaacgagcttgctggcgaaattgctgaatcactgtcataccattaatggtttcattaaagccgtcattaatatcagccagataactacgaacccgtctaataattggagtactgaaatgctgataaattatcattaccagcaaaactgctggaaatattgtcaaagcaacacatgccatgcgccaatccaaaataaacatagctatcagcattgccccgatcaatgaaatgcagcgaaacactgtagggatcacatttacaaacagatccttaatggcttcagtatcattcgtcacgcgggatattagctgcccaacgggctggctatcgaaggtgctcaacggctggcgcaatgccgaattcatgacatcagtacgaagcttctgaactatccccacagatgcctgattgaataataggaactgaaagtagtgcaaggcagcagcaacaaactgcaataccaaaaaagtaaccgcaagcccactgacaacatcaagcggaagattgcccgttgctaccatattatcaataaaatagctcacaagcagtggcccactgacttctgttagcgcagcaacccatgacatcagtacagccagcaaaattggcttgcgataattcttactgtaagacaataagcgctttaatgatggccatagcttacgcacactgggcttacgcatatcatgattagtcatgttcaccatccaattcggcttcaagttgctgataatggtacatatcagaataccaaccggattgtgcaataagctgtttgtgcgggccttgctgcgcaaccgtgccatgctgaataaccaaaatgttatcagcttccgttaaagcagacagccgatgggcgctgataataacggtacgctgtcgccgccactggctgagatttttcatgatttgatgttctgtctgaccatctacggcagaaagtgcatcgtccaaaatcaaaatttccgtatccaataacagagcacgtgcaatggaaatgcgttgcttctgtccgccagaaagcattacgccacgttctcccacttccgtttggtagccctgcggtaaccgcaaaatatcatcatgcacattcgccaaacgagcaacttcttcaatttgttcttgagttgcatcaggccggcctagcgcgatattgccagcgactgtatccgaaaacaggaaaggagtctgattaacaatagccaatcgtgatcgccattcttctaatctaagtgtagaaacgtgccgtgactgaaaaagaatttcaccgtcagtgacatcaaattgccgctgtaacaaggcaagcaaagtgctttttcctgcaccagttggaccacaaacccccaatagctgacctggtgataattgaaaacggacatcatgtaaaataggtctatcatttgcgggataaatgaaggtattgatatttgcctgtaatgtaccgcgctcaactaataaggactgagaaccatcatcaatcaccagtggctcctgtaacaagctacggatccgtgtatatgccgcactgccacgctcaacaatattaaacatccatgccaatgccaacattggccagatcatcaatcccagatacataacaaagctagtcaattcacccagtgtcatagagccatgtacgaccatccaactccctccaccaatcgctaataggtttgcaacgccaatagcaatgaaaatggtggggtcaaaacgtgcatctacgcgcgcaacgtgtatatttttacgtccagcatcagtagcgacttcttcaaattgactggattgcagatcttccagaccaaatgctttgatcatacggatgctggtaagactttcctgagcatggttattaagagcagagaatgctccttgtgcagacttgaaacgatggtgaagctgttcgccatatcgtttaatcaccaacgccataatgggcatgggtaacagtgataacaacgttaattgccaactaatttctatactcatcacgataaggacagcacatcccatcactaaggaatcgactaaagttagcaccccctcacccgcagcaaaaacaaccctatcaacatcattggttgcacgagccattaagtcaccggttctgtggcgcaaataaaattcagggttctggctgctcaatttctggtagaaatcactacgtagtttaacagccagccgataagacgccccaaatagccatacgcgccaaacataccgcagaccgtatatcgccagcgcaatgaacagcatgatgcctagccacatcaataattgactggatgacatcgtttttgcactgatgccatcaacgataattccgaccaaacggggaggaattaattgcagcatcgcaatcataataaggaagataatggcaccaaaataacggcgccattcgctgagaaaataccaacttaattgagaaaataatctcacgaaccgattcccaaagtaaaaatgaaagaattagcattaactccatcagaaagatttttgcattatctaatccggtattggtaacgccgttgtatattttattttttccattgcaaagttagaggtgacatcaatcaaaccagaaacgccattaaccatgcgtttgtagaaccgatcataacttttcatatcaacaacttctacatgtatcaagtaatcatattccccagccattcgataaaatgttaaaacctctggcatctcttttataaaagccacaaactgttcataccattcactactgtgctgttgagtttttatcatcacaatcacggtcagactaagcccaagtttagagccatttagcaatgcaacttttccgacaatgtacccatcatcttcaagccgttttagccgtttccaacaaggtgtagaggtcaaattaacggcttcggccagtgcattcaaggatcggctacagtcctgttggagcagctccagtagcttacggtctattttatctaacatatccaaatcctgtagaaaattcttccaaaagaaaataataaatgtagaaaaataacaatctatttcccccaatataaaagtaatctatatatcactaaagtagtattattcaggatcaatttatgtcgtcttcatgggctacaaatgccattaaagccatccaagctgattatcaacgaagtgctgatacacacctgattcacctcaatctccccgtgttttcaggaattcacctttatctcaaagatgaaagcactcatccgacaggtagcctgaaacatcggcttgctcgttctttgttcctttatgcactcagcaatggttgggtcaaagaaggaaccccaatcattgaagcctcatccggcagtaccgccgtttctgaagcctattttgcccgcttgcttggcttaccttttatcgccgtaatgccctcctgtacagctaaacgcaaggttcaggaaatcgaattctacggtggtaaatgccactttgtggaacactcagcccttatttatgaggagtcagaacgtttggcaaaaaagctgaatggccattatatggatcaatttacttacgctgaacgagctactgactggcgtggaaacaataacatcgcagaaagcattttccgtcagatgcaactggagccatttcctgaaccaacttatattgttatgagtgcaggaactggcggaacatcggcaacgctcggtcgctatatccgttatcagggatataacaccaaactgattgttgttgatcctgaaaactctgttttctacgattgttatcaccaaaatcgccgtgatatccgcggaatcaccagcagtaaaattgaaggaattggccgcccacgtgcagagccatcctttatcccaactgttatcaatgacatgctgcaagtccctgattgtgccactatcgccaccatttattggcttgaaaaattaattggcagaaaaactggcgcatcaacaggaaccaacgtttggggaactttacagctagccagacagatgcatgagaacaaccagaagggtgcaatcgtgacattgttgtgtgatagcggcgaacgctatcttgatacctattacaatccagaatgggttcgcaataatatcggtgatatcacactgtatctcacgcaactacccaagctagatggttatgagtaacatatctccttcaatttaaataggtaggtattatgaaacgagccgttgttgtattcagtggtggtcaagattccaccacttgtttaattcaggcactccgccaatacgatgaagttcactgtgtcacttttgattatggtcaacgtcaccgcgctgaaattgacgtggcctgtcgtattagcaaagaactgggtgccgctgcccacaaagtacttgatgttactttattgagtgagcttgcaatcagcagcctgacccgagacaacattcccgtgccggatttcagtgaaagtgaaaaaagtggcctcccaaatacatttgttcctggccgcaacattttgtttttaaccctagcggcaatttatgcctatcaggttgaggctgaagccgttatcaccggtgtttgtgaaaccgatttttctggctacccagactgtcgcgatgaatttgtcaaagccctgaataaagcagtttgccttggtatcgcccgtgatatccgttttgagactcccttgatgtggttgaacaaagcagaaacttgggcattggctgattattatcaaaaattgaatttcgtccgtacccagactctcacatgttataacggcatccaaggcgatggctgtagtgagtgcgcagcctgccaccttcgggctaatggattaaacctttatttaaataatactcaatccattatggaagagatgaaatccaaaacgcatctgagctgaccaattaattttacgcaataatcactatcattgagaggctgccaagcctctcactattttaaactttaaatgcttctaatctttcctgtatatccccctctaaagttaatgccttatgagttttcaaatcaatacaggcaaatgtggtcaaagcatcggtgagtattttattatcacttctgcgtataatctcctgaaaaaatacaccacttttattacgtaattccttgaggctagacctcacttccaactcatccccaaacactgccggcagacggtaattgatgttaatattaactacggcaaagccaacattattagtttttaaccacgtgagtgtgtcactttctgtcagcaaatcccagcgagcttcttccatgaattctaaataacgagcattattcacatgctggaaaagatcaatatgatagcccctgaccttaataattgtacgcattgctattttcccctttcaactcatccgaccagacagttaacaatagcaaaacattttaattacaatgctatttaatgagttattcttgatcaatatcacagccctcttgactctttatgcgattagcatggtattcaccaagagggcttgatgatcaataggttaatttatcccgattcttttccattaaagcaggaccaatgccctgaacttcctgtaactgctcaattgccgtaaattgaccatatttttcacggtattcaataatcgcctgagcctttttggcgccaacaccattgagttccttcactaattgttcagcattcgccgtattaatattgatgcttccttttccctgaatttccttttctgaggctaattctttcccctccttcacatcatttttttcaataacagctttgtgttgattggtagattgtttcacagctttatcaggtgattcatccgctgcaatcgcatgagataacggcatactgatacaaaaaaccataacaagtgaattaaataatgtccttaaatatttcatataaattcctccgtgttttgttgacggaggaaagcttgccataacagaatttatggacaagaggaaaggttcaaatatgcgaaaggccacgaaagtggcctttttcaattgttgttttgcaaaaatagttgcgagaagcttcgcaattttattcaatctgccccatcttaatctcggcatcatcacgcaaattaatcatcaaggattccagcatgaaagtaccgatttgatactgatacgccgctatgtattgtttaacctgttcttctgaaacagaacctgggacaactttatccaattggataagcactgcgttgccaaacccatcttgggctaaaccatactcagacttgccatctttaggatgaggcagagtaaatgctacattagtagcctgattagtttgtgataaatgtttgatcacagtggagacaccaaactgaatcccagcggctttcagtgcctgctcacctttaccttctttcaaagcagccagcagtttttcactttcaagctgcaactgcttttcagctttctggcgttttactaattcagcaatctgagttttggcctgctcgtaaggctggatagtttctggcttgatatcatcaacacgtacaataaaggctctgtcaccatccacagaaataacatcggagttagttcctgatgcccctttatcatcgataagatttccagagaaaatagtctgaaccaccgaaccaaaatttatttcagcaggaatatggtcacgatcaaaccagtcagtcgtcacagctttataaccagctgctttttctgccgcagtcaaagattcgttatcattggcagcggcatcacttacttttctttgcaatgcatagaatgcatcaaccgctttttcctgtttaacgattttttctatttccgaacgcacttcaaccagtgattttattatctgaggtttaatatcatctaaacgaaaaatagcatatccaccagatagcttgatgacaccagaaagctgccctttttctatcaacttagctgacttaatttcatcaggtagggagctttcttccatccaacccagatctcctcccttttgagcagaaaatttatctgtcgatttttctgccgccaatttgctgaaatcagcgcctttctttaattcatccaaaactgatttagcttcagcatcagacaccaactgaaccatgctgtattttttttgctcgacctgcatatactgtggcagattgtttttataatatttttcaatatcggcatcagatacggtgacgcttttcaattcatccgcagcatccatcttgatgtagctgactttcaccttttcaggcacggtgaaactattgctattaacgtcatagtagtttttcagctccttatctgtcactttttgctgtgcttcaatggatttcagctcaagtgtagcgaaacgaaccgttctttcttgaaaggccagcgctgtttcctgtttgatctctgtcggcaaagcaatttctgaacccgtcaatatcgacatcaattgacggttaatcagatcttgacgaacctgttcagcaaagttatctgggcttctgtttgcaccggtaagcaaagtcagatatttattgttatcaaatttaccgtctgtctggaaaaaaggtaggttacggatctcttctttaacctgctcatcgcttgctgacaagcccagcttacgtgcatattgatctgatagaataacagtgatgaggcgatccagtgagctgcgtcgaatttgttgtactttctgctcatcacttaacagagttgagaattgatctcccagcctatcctgcaacgcaattttgtcttgctgaaatgcttgctctaattgagcacgactaatggtttgaccattcactttggcagcataattaccaccttcacttgacaggtagcctgttacacctgtcaaaacaaaggtcaggataattaaagccaatacaattttaagcacaggaccgtttgccgccgtgcgtaggttgtccatcataaagacgtaaaactccgctttagtgaaaaagaaactaccatattacgctaattcaaacgctaagagaaaaaaagcgcatcaaccaattggttggtgcgcttacattctaacctatcaaccccgccccgtcagtttaagtttaactgtaatggccaaagcgagggaggatgtttcatattcattactcattaacagcatctttcaatccctttcctgcgcggaaagcgggtacttttgctgctgcgattttgatttctttgcctgtctgggggttacgccctgtacgagctgcacgttcacgtacagtaaaagtaccgaaccctaccaaaacgacatcatcaccgtctttcaatgcatcagatactgaagaaatgaatgcatctactacacgcccggcagctgctttggaaatatttacatcagcagcaattttgtcgatcagttgtgacttgttcactcttatcatccccatttagttttactatcgtaacaaataccgatctctaacggataacgcgacagccgtgccgttatatcaatcccttccagtattagcaaaaaatcatggaacagcaaaatatttaatcggatatgtggattaagctaacttaatgagacaaaaaaaggctggcaagtcttaataaactcgccaacctaaattttatacaaacttcttgagttaactcactattttcgtactaatttagtgatactgcttctgctccaaacgcaggagactgtaaagcaatagacaaaacatcttctatgcgcttaacaggatggatctccaaatcttgaataatattctgagggatctcttccagatctcgtttattttcatctggaatcaagacggttttaatccctccacgatgagctgccagcagtttttctttcaaaccaccaataggcagtactaaaccacgcagagtgatttcgcctgtcatagcaacatcggcacgaaccggattacctgtcaggcaggaaaccaacgcagtacacattgcaatacctgcgcttgggccatcttttggtgttgcaccttcaggtacgtggacgtgaatatcacgtttttcatggaaatcagaactgatacccagtttatcggcacgagcccgaaccacagtcaaggctgcctgaatggactcttgcatcacttcacccaacgaacccgtataggtcagttttcctttacctggcacgctggctgtttcaatcgttaacagttcaccacccacttcggtccatgcaaggccagtcacctgaccaacacggttctcagtatccgcacgaccataatccacacgttgaacacccagataatttttcagattatccgcattgatttcgatgtgcttaagcttcttatccatcaacaatgccttaacagctttacggcacagtttggaaatttcacgttccagattacgtacaccagcttcacgggtgtaataacggataataccgagaatcgcaccgtcatcaatagccaattcaccttttttcaaagcattacgctcaatctgctttggcagtaaatgccgcttggcgatgttcagtttttcgtcttcggtataacccgacagacgaataacctccatacgatcaagcagtggcgccggaatgttcatcgaattggacgttgccacaaacataacatcagacagatcgtaatccacttcaaggtaatgatcattaaatgtcacgttttgttcaggatcaagaacctccagcaatgcagaagccggatcgccacgcatgtcagatgacattttgtcaatttcatctaacaggaacagtggatttttgaccccaattttggacatcttctgaaccagtttacccggcatggaaccaatataggtacggcgatgacctcggatctctgcttcatcacgtacgccacccagtgccatgcgaacatatttacgaccagttgcacgcgcaatagaacggcccagtgaggttttacctacgccaggaggccctaccaagcacagaatcggccctttgattttgctgacacggctttgtactgccagatactcaaggatacgctctttgacgcgctccagaccataatgatctatatccagcacttcctgcgccttgaccaaatcttttttcaccttgctgcgagcaacccaaggaacttgtaccatccagtcaatgtagctgcgtaccaccgtcgcttccgctgacattggagacatcatttttaatttctgcagctcggcttcgaccttttcgcgtgcctctttcggcattttagcgtcttcgatcttacgtctcagcgtttcatattcatcaggtgcatcatccatctcacctaattctttctggatcgctttcatttgctcgttcaggtagtattcgcgctggcttttttccatctgttttttgacgcgattgcggatacgtttttctacctgtaacagatcgatttctgattccatcattgcaatcagatattcaatacgttcaacaacatcagacatttctaaaacagtctgtttatcgttaatttttaaaggcatatgggcagcaatggtatctgccagttttgctaaatcttcaatgctgtgtaatgatgtcaatacttccggcgggatcttcttgtttagtttgacataaccctcaaactgattaatggcggttcttaccagaacttcctgctcacgttcatcaacgacaggggattcaagatattcaacctgcgcatagaagtactcactattatccgtcaatgttgtaatacgggcacgctgcaaaccctcaacgagaacttttactgtgccgtctggcagtttcaacatctgtaacacagaagccactgtacctacggagaaaagatcattgactcccggctcatcagtggatgcttctttttgcgcgaccaacatgacctgtttgtcatgatccattgctgcttccaggcaatgaatcgacttctcacgcccaacaaacagagggatcaccatatgtgggtaaaccactacatcgcgcaaaggcaatacagggatttctatgcgttcggaacgctcagggttcatagagctctctcttcgtttagctttcgccagtttttaggaatctcgtgaaacacggttttcacgagtttcacttcaaagaatacaaaatatatggggacaggaatctcacattcaatagcctatgcctgcaaaaagcaaaatgagggagaatccctcatttttattttttcaatacatattgataatcagtatttcctaccctattttcatcactcaccagaaacttgggcatccggcttgctatatatcaataatggcgctgatttctcttcaacaaccgtttcatcaacgacaactttttctacatgttccattgatggcaggtcatacatcgtatccagtaaaacaccttctacgattgaacgaagaccacgtgcaccagtcttacgcgccatagccttcttcgcaatcgctgtcagcgcttcttttctgaactcaagttcagcaccttccagattaaacaaagcctgatactgtttggtcaacgcgttttttggctcttgtaggatctgaatcaatgcatcttcacttagttcagtcaatgttgccacaactggcagacggccaatgaattcaggaattaacccaaatttgatcaaatcttccggttcagcctgagcaagcaattcgccttctgttgctttctccgactcgcctttaactgtagcactaaaaccgatacccgagctgacattcaaacgctggctaataactttgtccaatcctgcaaatgcaccaccacagataaacaagatcttagaggtatcaacctgaagaaattcctgctgtggatgtttacggccaccttgaggaggaaccgctgccactgtaccttcaatcagcttcaaaagtgcctgctgaacgccctctcccgagacatcacgagtaattgacggattatcagatttgcgagaaattttatctatttcatcaatatatacaatcccacgctgcgctttctgcacatcgtagtcacacttttgcagcagtttctggataatattttctacatcttcaccaacataaccagcttcagtcagtgtcgtagcatcagccatagtaaaaggcacatctaaataacgggcgagtgtctcagcaagcagggttttaccactacctgttgggccaatcagcagaatattactctttcctaattccacaccgttattagtgtcaccattacgcagtctcttgtaatggttataaacagcgactgctaacactttcttcgccgtttcctgaccgataacataatcatccagatgttgacgaatttcatgaggagtaggcaaggcgctacgctcacggtgtggtactagttctttaatttcttcgcgaatgatatcattacataaatcaacacattcgtcgcagatatacactgacgggccagctattaatttccgaacttcatgttggcttttcccgcagaaagagcaatacagcagctttcctgaaccgtctttgcgcttatctgtcatcagtcaacctcactttatgagctgttatcccagtttatctggcataacagaaaatacgctgtcattactccgccgagtaaggcgccaacaaagaaacgcccttaaacttatagcgtcggagtaataaagtaattgtcaataaattagttgcgctgggtaaatatactatcaaccaaaccgtattctacggattctgcagctgataagaaacggtcgcgttctgtatcttcgacgatcttctcaagtggtttgccagtatgtttcgccatcaactcattcatgcgagctttaaccttgagtatctcctgcgcatgaatttcaatatctgtcgcctgcccttggaaaccacctaatggctggtgaatcatgaccctagaatttggcagacagaaacgcttaccttttgctccagctgtcaacaggaatgcccccattgaacaggcttgccccatacagatagtactcacatccggcttgataaattgcatcgtgtcataaatagacatacccgctgtaataaccccacccggagagttgatatataagttaatatctttttctgggttttctgcttccaggaataacatttgggcaacaattaagttcgccatatgatcttcaactggcccagtcagaaaaataattcgatcttttaataaacgggagtaaatatcgaatgcacgttctccacgtgcagtttgttcaaccaccatcggcaccaaagacatgttaggtgcatatttatcttgcttgccactgtatgacatttccgtctcctaatagaactcacgctggtgccattcataactgattctacttgagataagcgatgatgaccatgatccaaagttaactaacagagggctttctccccctaaaaagtagtaagcccttacataatagtaagaaaggatatgaggttaaatctgtttttttcaaggacaataaaaaaacccgcaagcatagcctgcgggtttgcattactgagagaaatttcattatctcaggtaatcaataaatgaaacttatgccagttgattttggttcataagatcattaaagccgacttctttttcagaaacttttgctttattcagaacaaattcaacagcctgctcttccagagcaatattgcggacgttgttcagcatttctttatttttgctgtagtattcgatcacttcttttggatcttcgtaagcagaagccatctcttcgatcaacacattaacgcgatcttcgtcaactttcagctcattgctgctaatgacttcacctaacaacaaaccaacaacaacgcggcgttttgcctgttcttcgaacagttcacgtggcaattccagagcttgtttttcattgccgccgaaacgctgagcagcctgacggcgtaacacatcaatttcgccatcaataaccgctgctggaacttcaatttcgttcgcattaaccagaccatcaaggatctgagtcttgatacggctacgaaccgcgttcttcagttcacgttccatatttttgcgcacttcagtacgcagaccatcaacagtgccgtcagcaataccaaaacgtttgataaactcttcggtcagttctggcagttcacgctgttcaactttctttaggttgatagcaaacgttgcagctttccctttcaggttttctgcatgataatcttctgggaaagtcacatcgagggtaaattcttcacccgctttgtggccaacgacgccctcttcaaaaccagggatcatacggccctggcccattgccagaacgaaatcagttgatttgccgccttcgaactcttcgccatcaacagaaccagtgaagtcaacagtgacgcgatcttccgcagccgctgcttcatcagtttctttccaatctgcctgttgtttacgcaaagtttccagcatagcgtcaacgtctgcatctttaacttcaacaaccggtttttcaacttcgatctcttccagacctttcagttcgatctctggataaacttcaaactcaacagcataaatgaagtcttcaccatctttaaactgctctggtttatagcttggtgcgcctgctggattaattttattctcaatgatcgcattgacgaaattgcgttgcatcagatcaccaagaacatcctgcagaacggaagcgccgtaacgctgtttgacgatattcataggcactttgcctttacggaaaccgtcgatacggacttttttcgctacattaaccaattcactgctaattgctttttcaatgtcggcagcaggaacggtgattgatacacgacgcccaaggccttgagtggtttcaacagaaacttgcatcttgttacctcaaaaaaatcatagtgctcggtcaacttcagaatgtcgtaatgcctgaaaaactggctgattacaacactcatcaagaaccggggcggtcgtatttaaaaaccgagaatccctgtgatcagaagcgtcccgaaaccattctaaaaattcagacgcagcattatagcgacgcagacagtatgagtcgagaattgcagacagaagcaggcaatattcgttgacttctgtgataaacatggctcaatgactgcatcacgatatcgtctatccggtgtgaatatatacaaaaatacagcccgaaggctgaagtctaaaattaaaatcagattaataaaataaaaaattaagcaggatatatagtctaacccggaaaaatcacaaacctgacgtcgtcgttcttcctccccggcatgcaggcgaagctagaacagtgtctcccaattctgcccactctttttccgtataagtatgaagcgctaaagcatgtacgccttcttccagctctttggctaagacactatatactgcgcgatggcggttaagtactcgatgatcgacaaattcattactgatcacaattattttaaaatggctttcagaacctgctggcacattatgacgataactttcatcgatcacttccagatgagaaggcttaaatgccgcctgtaactttatttctatttcctgacgaaccatcccattctccttcatcaccaaaggttatttatcaaccatataattgattctagtttatttcccgtgagttataacatcagagtagccaaatatctttaacagaatttacttgggggtatttctccctatgtttcaagcattcattagggatatgccgctaccaatggcaatgctatgattgcgactgtttatactaccggtattaatatatcgggtatccgtatcctgaatgagaaaatctacatgctaaaaaaaatatttacttcattgcttgcacttttctttttagctggctgtgcaaactccggcaatacattggcaattcaaccaaaaattaccctgccacccgtagatccgacaatgaaagcgatcacaatcagtattagtggggtcgatcatcgtcaatctcaagcactggctcaagttaaccgtgatgccagactggttaccctgacaccttcccgtgatttacggtttttactccaagaagcactggaaaagcaaatggtagctcgcggctatatgattggttcccccgccaatgccaacttacaagtcgttgtgaatcagctttatgccaatgtaaaggaagggagtctacgccacgatatttctacaaaagcagaaatctccattattgtttatgcccaagatggcagtcagcaaatcaaaaactatcgcactagctacaatgttcaagggccattaagtgcaacaaatgcgaaaattgctgatgccgtaaacacagttttatctgacgtgatcgcagacatggctcaagatttgtcagtcagcaccttcatcaaacaaaacgttcgctaacaggagatgaaaaaactttctgccaaactctgcccagttaggtaatgtgcagaaagttttcttgggaggctcatgactaatcattatctcaataagctatccacactacgcaattattacatccttcttttactaggttttgcctctggtctacccctagcactcacgggaggaacattacaggcatggatgacaattgaaaatctggatatcaaaaccatcggttttttcactttggttggtcaagcctatgtctttaaattcctctgggctccggcaatggacagatattcgccctcatttttagggcggcggcggggatggatgctggtcactcaactcctgcttatcgtcagtattgccacaatggctttcctcaaaccatctgaacatttatggtggctcgcagcattagccgtctctgtcgcattcttttccgcttcccaagatattatctttgacgcctataaaaccgacttactttcacaggaagagcgcggttccggtgccgcaatttccgttctggggtatcggatagccatgctggtttccggtggtttagcattgtggctgaccacctatattggctggcagaatatgtacttgataatggcaggtatgatgctcattggtgtttatgccacacttactgccaaagaaccaaaaattaatacagcgccaccaaaaacattacatcaggcagtattagaacccttatctgatttctttagccgaaacaatgcctggcttatcctgctattaattgtactgtataagcttgctgatgcatttgcgctctctctcagtacaacgttccttatacgtggtgttggcttcactgctgctgaagtcggtatgatcaataaaaccctcggtctggctgctaccattgtaggcgctctatatggcggctatttgatgcataaatggagcctgtttcgcgctctgatgatatttggcattctccagaccgtttcaaatttgagttattggatacttgccgttactcccaaagacatctacgtgatggggggcgctgtttttctggaaaatatctgtggtggcatgggaacagcagcgtttgtcgccctgttaatgaccttatgcaataaatcattttcagcgacacaatttgccctgctttctgcattagcagcaattggacgggtttatgtcggcccggttgcggggtggttcgctgaatctcatggctggcctatgttttatctgttctccattttcatcggattaccgggtctgtggcttttatttatctgccgtaatacactgacttataccgaaaaaaacgataatttcatttcccgcacattattcaagagctattatcggattgccttcattatcatgctgctcgccgcctccatatttataatttggttaatctgtagctgcctgataattatcatcagtagtattactcattttatcgtcctcgatggacttcaaaaagcaatttcgcccgtattctcattcagtatcgcaatgggtactgtaggacttctattgggaggagcgctggattatttagctttgaggaaaaccaaattcgcttagtgtgttcccccagaactcctactatagcatcttagatgcgctttctgaaaaagccaaaggttggcagggttcaacctttggctgccttattttagtgataaacttcacaataaaaataaaaacagccattatgtgacttggaaaacgtcttttttaagagcggaacatttatattcacactaacaaatattattatccgaattattttattccgaaccattcaagacatctttatttatcctaaaaccatataaagggaatttatgaaaagacatattttgacactcaccgcagttgctactgccttggtttctgcatcagccagcgcggaataccagtggggttttgccaatgtcagcatgaactaccttgactggaccaaacacaccactcaaaaaacagggcagacctcacataaagatgactttgcttatttggaactagaaggtggatcagagttcagttggggcgagctatatggtttccttgatttagaaaatccatttaacagcaaaactgcacagccccggtgataaccagcgctacaccttcaaaaccacaggtcgtttttatctaggtgatactgggttcaacctttatggtcatgtttatggtacctattcactgccaggcaaagccaacggtggcaacttccatgaagtaaatactctctatggattgggctataacaccacactggctggtgtttggttcaaaccttttgtcgcacttcactatgttgatcaaactttttactcaggtaataatggttatgtcgtaggctgggttgcagggtacgatttccaactctggcaagaaaaattcagtattacgaactggaatgaaattgagttgaaccgtaatcagcgctacggcaacggtggccgagagggtatcaatggtgctgtcgggttatggtggactccacatccttcctttactactgggattcaatatcgctatgcggataacaaattaggcgaagatttcttgcaggatggcattgtttacagtgtaaaatataacttctaaaataaatttaactgatgagcagcaacaagctgctcatcaacaccgataaacaacggttattatattgttaaaaacgcttgttttagctttatttcctttggttttcgtcaatttttcctttttaaaaatagtaagttattttaaaataaatacttattttgaactcttggttaaaataactatctgaaattaactttttgttaaaccttacatcacatgtgatccctctaacataaaaagcctacaagttatcttgcttccattacaattgtttacactccggtgaccttaccgtagaatgcccgcactgatgaaacgacaataaagcttttgttatctggggtcgctcaatgagacttatgaaatacaaaaaaactattgggttgtcgtcattactcgcagccactttaatgctaagcggttgtgatatggtattgatgaatcccaaaggggcgatcggcgttgagcaaaaaacgctgatactgacagcgtttggcctgatgctgatcgttgttattccggctatcgtaatggcaatcatttttgctctacgttaccgggaagccaataaatctgctacttaccgtccaaactgggcacactcaaataaaattgagcttgtcgtctggactgtgcctattctgattatcatcgtcttggcaactattacatggaaaacgactcaggaactcgatccatataagccattggactatgaagaaaaaccggtaacgattgaagttatttcccttgactggaaatggctatttatttacccagaacaaggcattgcgacagtaaacgaaattgcattccctaccaatgttcccgtgaacttcaaaatcacgtcagactctgtgatgaactcctttttcatcccacagttaggcggtcagatttatgcgatggcaggcatgcagacaaaactgcacttgattgctaacacaccggatacatataaagggttctcagcaagctatagtggcgaaggcttctctggcatgaaatttactgcaacagcaacacccgatcgtgaaagttttgaacagtgggtgcagaaagttaaggcatcacctaaaaccctggatactgtgcaggcgtttaatgacttagctgaaaaaagccaaaataatcctgttgaatacttctcaagcgtgaaaccaaagctattccaagaaactatcaccaaattcatgggtgacatgaaacatggtggtatgtttggtacggcaggtcacggcaaaacagaacatggtgaagctgcggatcataatatgcatatgagtcagccggctcatgcaggtgttgaggaataaaggcatgtggggaaaattaacactggatgcaatcccactacatgaacccattattgtggtgactctgattgcaatccttctcgggggactggcggttgtcggtaccttaacttatttccgtaaatggaaatggctctggagcgaatggttaaccagcgttgaccataaaaaaatcggtatcatgtatatcgtcgttgccatggtcatgatggttcgcggtttcgctgatgccatcatgatgcgtggacagcaagctctggcttccgcaggtgaagccggcttcctgcccccgcaccattatgatcaaatatttaccgcccacggcgttatcatgatcttcttcatggcaatgccgttcgttgtcggtctgatgaacatcgtagtacccctgcaaatcggggcgcgtgacgttgctttcccattcctgaactcactgagcttctggttattcgttgtcggtgtcgtactgatcaacctctccctcggtgtaggtgagttcgcacagacaggctggctggcctaccctcctctatcgggtaaattatacaaccccggggttggtgttgattattggatatggagtctccagctctccggtatcggtacattgctgacgggcgttaacttcttcgtgactatcctgcgtatgcgtgcgccagggatgtctatgatgaaaatgcctgttttctcatggaccgtactgtgtactaacgtactgattattgcagcattcccaatcctgacagtcactgttgcactgttaactctggatcgttatatgggcacccatttcttcaccaatgatatgggcggcaatatgatgatgtacatcaacctgatctgggcttggggccatccagaagtttacattctggttctgcctgtctttggtatattctctgaagtcacagcaaccttcgcgaaaaaacgtctgtttggttatacctctctggtatgggcgacgattgttattaccattctgtcgttcattgtatggctgcaccacttctttacgatgggctctggcgcgaacgtcaacgccttctttggtatcgccacgatgattatctctatcccaactggggttaagatcttcaactggctgttcaccatgtaccgtggtcgtatcgaatttaaaaccccaatgctgtggactgttggcttcctcgtcactttctccattggtggtatgacaggtgttctgctggccgtacctggtgcgaacttcgttctgcataacagtttgttcctgattgctcacttccataacgttattattggtggtgtggtatttggctgcttcgcaggtactgcttactggttcccgaaagcgtttggtttcacactgaacgaaaaatggggtatccgtgcattctggttctggatcaccggtttcttcgtagcctttatgccactgtacgcactgggcttcatgggcatgacccgccgtctgagccaagatatcgaccctgcatttcacactatgctggttgttgcagcgggtggcgttgtcttaattgctcttggtattctgtgtcaggttattcagttctacgtcagtatccgtgaccgtgaacaaaaccgtgatctgactggtgacccatggggtggccgtactttggaatggtcaacttcatctccgcctccattctataactttgctgaagttcctcatatccagactcgtgacgcatggtgggatatgaaggagaaagacactgctcataaacgtccggctaaatatgaagaaattcatatgcctaaaaacacaagcgcgggcatcattatcagtgcgttcctcctgatcttcggctttgccatgatctgggatatctggtggctggctatcgcaagtttcgccggtactatcatcacttggatcgtgaaaagctttgacgaagatgttgattactacgttcctgtagctgaagttgaaaaaactgaaaatcagcattacgaagaactgagaaaggcaggtgtgaaataatgtcgactcaaacccttaacaacacagccgcccatgagcatcatgggcaccatgacgtaggctccatgaagatatttggcttctggatctacctgatgagtgacttggttctgtttgcaagcctgttcgccacttatgcagtactggccaacggcacggcaggcggtccatccggtaaagatatttttgaattgccatttgttctggtcgaaaccttcctgctactgttcagcagtatcacctatggtttcgccatgctgagcatgaacaaaggtaaaacaggccaagttaacttgtggctgttcattactttcttgttcggcctcggtttcgtttcgatggaaatctatgaattccataaactgatttcagaaggttttggccctgatcgcagtgcattcctgtcatccttctttgctttggttgccactcacggtatccacgtaacttgtggcttgatctggattattatcatgatggttcaggttgcacgccgtggtctgacggaagtgaatcgtactcgtctgagttgtctgagcctgttctggcacttcctcgacgtagtatggatttgtgtatttactgtcgtttatctgatgggagctatgtaatgagtcatccaaatacttctcattccggtgccgaccacggcagtttcaaaacctacatgattggttttatcctgtcagtcatactgaccgtaattccattctggatggtgatggatggcagtgcttcccagagcacaatcctgcttacagttatcggcatggccgtgattcagatctttgtacatttcgtctgttttctgcacatgaacacatcgtctgaagaacgttggaacctcgtcgctttgatattcacattgcttgtcatcgctatcgttgttgtcggctctctgtggattatgtacaacctgaacatcaatatgatggttgattaaagagttgacttgaatgattaagcaatacctgcaagtgaccaaaccaggaattattttcggaaatctaatttctgtggttggaggttttctactcgcttccaagggcgtaatagattacccattgttctttgctacgatgctcggagtatcgttggtagttgcatctggttgtgtatttaacaactatatcgaccgcgatatcgaccgaatcatggagagaacaaaaaacagggtccttgttaaagggcttatcgatccgaaaatcagcctgatttacgcctcagtgctaggtattgctggcatagtgctgctctatatagcagccaatgctttagcaatgcagttagccctcatcgggtttttgatttatgttggggtttatagcctctacatgaaaagaaaatctgtttacggcactctggttggtagcttgtcaggtgcagcacctccagttattggttattgtgcagtaacggggcagtttgacacaggggcactcatactgttgttaatcttcagtttatggcaaatgcctcactcttatgccattgctatttttcggttcaaagattatcaggccgccaacattccagtattgccagtaattaagggtatttctgtggcgaaaaaccacatcactctatatattctggcctttatggttgccaccttgatgctgacaatcagcggctacgcaggttacaaatacctcatcgtagccgccgcagtgagtatctggtggttaggtatggcattatcgggttataaaactgctaatgatcgtatctgggcccgtaagttatttatgttttctattgtcgctatcatgtctttaagcgtcatgatgtctgtcgattcaacagcatctccagaaactcttctgacttacgttcggtaatatcaagagggcagggttttccccctgctcttttttcctttcccttatctcttaattcatttacaacttgtttatttataaacgttattttttattcatataatttaattactaatgagataattagcattttacagtggcatattcctatttaagtgaaatgtcatatcgaattttctgaggtatcatgaacgataataaaatgactccgcttgaacttcgagcaacatggggcttaggttctgttttttctctgcgcatgttaggtatgttcatggttttacctgttttaacgacctatggcttagaattacggggttccagcgaagcgctgatcgggattgccattggcatctacggcttgacacaggcaatatttcaaatcccattcggattgctttcagacaaaatcggtagaaaacccctaatcatcggtgggctgcttatctttgttctaggcagtattactgcggctttgagcgactctatttggggcattattatcggcagagccttacagggtgctggggcaatatctgctgcaatcatggcattactttctgatcttactcgcgaacagaatcgtacaaaagcgatggcattcattggcattagttttggtattaccttcgcctttgctattgttattggccctatcatcacacaccaaatagggttaaatggcctgtttggcgcaatagcgatcctggccagttgtggtatcttgatcaccttattcgctgtacctcctgctcataaacacatactgaatcgcgaatctggaattgcccgtggcagttttcgacgtgtgctctctgactctcagctactaaaactcaattttggtattctcagcctgcatactttattaatgtcgagttttattgctctccccctcatcatggaaaaagcagactttccaccacaacaacactggaaagtttacttaattactaccctcatttcttttattgctgttttacccttcattatctacgcagaaaaaaaacgccgtatgaaacaggtttttttactttgcatcggcctattattcatcgccgaattaattttatggtcagtgagctcacacctttggggaatttttgcaggtattcagatattcttccttgcttttaatatcatggaagctattttaccatcactcatcagcaaagaagcgcccgctggttacaaaggtacggcgatgggtatttactctaccagtcaattcctcggtgtcgcattgggaggtttcctcggtggaatgctctatgaactgcaaggcgcatcattggtatttatggggggtattgtgctaaccgcactctggtttattatcagcctgacactacatcaaccaccttatgtcagcagcatcagaattgtcttacccgatcaattgaataatcctgacatcttagaaaagaaaatattgtcacaggcgggtgtgaaagatattgtcatcgcattagaagaactcagtgcatatgtcaaagttgatacaaaacagaccaaccgagagcaattagaacagcttgtgctgtctcataaataatcgccgccgtttgtaatagaacagtacggtgcatagaaataataccctagcaccgtactatgtctgtattgggtaatttacccaataccatgctttaaacataacactttatttgttagttttgcctttataatagaaaggctccatgtcaattttcttaatcaacaatgggcaccccagaccttcacgagctgcattcactaatggccctctgtcctgatctgctgtccaagtaaatactccacctagatttttttccaatgcatattttgctttggctttcactgtacgcggtgtatccagtgatataaacaatttactgttttggttataaagatagtctgcatccgcaacttcatctgtataaagggtaaaaccatttctatcttgacgagactctagattcaaataattatatatcgtgtcataccattctgttgaaccggactcaaatgtcccagtcgtcgtacccatttcagggctatagctgcccgataatggtgaataactggtaatattagtatttttgccattacgagaatatccagcataaccaatattgatagcttgagatggcacaccaacactgagtagatactcaaccgctttttccacactattttcactaccaggataacggcgcaaattagtatggtgccttaacttatcagcccacggagtaccaaagaaatcataggtcatgacattaattccatataatccaacctttaataattcaggtattttggatttttccataatatctggtacggcagagcaagcgatactaattttaatatcagaacgtcctgcattcttaaatgcagaagataaatctcggattaggctaatataatactcaccgtctttcgggtcgtgcgggttatcgtttcctttcgctccaggatattcccaatcaatatctacttcagtgaacatggggaagcgtttaaagatatcgatcaaactggaaataaatttggatttcaattggctgttcctgaccatattgtaaaaaccattactcatggtccaaccaccgacgctgaatgacattactagttcatggccttgcgcccttgctgcatcctgtatttttgccaacccacctagcactcccatagatttgtcctgcttgaaatctctgggcatttgaacgtcttgccacctagggaaagtacagtttacataagattgacaatcgccccattcatcggtaaatgtgacttcaccattattgtaacgaccaaacttcggtgctgcccgagaaattaacgcttttttctcaccttgatcacctactatcccacagaaaccgataattaatttatcataggcgaaagggttatcaagcaagtgttgtaaatcaatacctcttccccgcgctgaaggagtttgattaccttgcaggcggctatcatattgtgaccaatcagtataataacctatgaccttaggtttatttttaacgttatatttattataaacgggtaaagcaactcttccagatgtataactaaattttgttgtttctgttgccgaaataaaatgatctaaacggtaagattcttcactgcgaggatccaactgagttaactttgacataaactctcctttatttaaaattagaattacatgtctaactatataacttcgatcatcatcctaactcacgcatttttaactttatacctcatcatttattagtattatattatgaatcgcgttctacaaaaaaatagaaattcactcggaaattattttaaataaaaataatcaagtttatttgatgggaaatttattaagggaagcattagtaattactgaaattactctgcttcccttaaatattttggtcaatccaaaaaaaaccgtcgattaccgtaaattaatcacggaaattagtaaactggaaaggttgccccaactctgcaccacgaaccagtgtcatcacactttgcaggtcatcgcgcgctttgcctgtaacccggacttgttcaccctgaatctgtgcctgcactttcagtttgctgtctttgatcagcttcacaatcttcttcgccaatggtgtatcaataccttgcagtaaggttgcctctacactaaaggttttaccgctatgaaccatattttcagcaacattgagcaccgagccatcaactccacgcttggcaaatttttcacgaagaatatcaaccaattggttgacttgaaagtcagattcactcgcaatcttaactgattcgttcttctcgtttaattcaaaactcgcattgacgttgcgaaaatcccagcgattggttaattctcgctgtgcgttctctactgcgttacgcacttcctgcatatcaacttctgaaacaatatcaaatgatggcattaccagtcacctcctccttatcaataagttggcatgataaccgctttccattattggcaaaagatctatactcgggaggttctgcgatcttttggcatttacgctactttctgagctcgtttgatttgagatcgtttgatttaaggccgtttgaaatcagcattgtttcgaggttctccataaaagtgcctctcatctcaaggaagtatatgaaaatcaccgttcttggctgtggtgctataggtaaactgtggcttgtggccttatcccagcaaaatcatgacattcaaacatggataagggttccacaaccttttgtctcggttcgtatcgataacttcaatggtaaggtatttgatcaacaatttcctgccaatgacgaaaaacatctcaccgaaagcgaattgttgctcgtctgtttaaaagcatggcaagtttccgatgccatcaataacctcgcccctaaactttcccctcattgtccgatcctgttactacacaatggaatgggatcacaggaagaatttttacctttgcccaaccccattttacttggtgtgaccactcacggctcctatcaggaaaatggcattgtttaccacaaatcgcaaggtattacccatattggttccgcaacggctaacgccgataaattcagttttctggcggatgtcttacactatgcactacccgatgtggcatggcacaatgaaatccacaccatcagttggctcaagcttgccgtcaactgtattatcaatccactcacagtaatttatgactgcaaaaatggcaatctattgcagcatactgcgcaaatcgatttactgtgcgacgaaattcaccaagtgatggaacgcgataatctgcatacgaccaaacagatgcttgttgattatgttatgaatgtgattgaacagacttccgaaaattattcatccatgctacaggatatacgagcacaacggcatacagaaatagattacattacaggttttttactacgccgagcccgtgcttatgggttgcccattaaagaaaatactattatttatcaatatattaaacgaaaggaggaggagtatgaacgcctccgccctcatctgcctggctcacggcagtgaagaaaccgaagctgttaccactattgatttactggttcgagcagagattgatgttaccgaaagcggtaccgcaacagatggtaccctcatactaacgtattcacgtagcgtcaaaatcgttgccgatacaccgaaagggtcaatttgctgcacagctagtattgccacttggtgtcaataattaccagcatcagcaataaaaaccggatttgcacaaactacttacaaaatatcatttctgtaagtagttctgcgtccagattccagatcaaggccgataaatcttcacgttttcgaaaccttgctctcgtagataaagagcctgtaagcggctcataacgcctctttcacagtaaagcaggtaatttttctcttttggcagatcaccaaactgagtgcccaacttatagaaaggcaatgactgaatttcgattccatccatacttaatgggcgatcatcttgctcatctggcgcacgaatatccagtagcacatcactggtggaaaactcagtgactgtttccacttcaacaacctgctcacacgcctgcattgcaatctgacggatatccatattttgagcttcgcttaccacacgatccagaatctcaaaatcaaaattggcttcttccgcttcaattttagctttcaccgctttcacagttggactttttgaaatcacgccacaaaattcaggcatggtacgagcaaaatcttccgtaccaatctcacgagccaacttaatgatgtgctctttatcatgagaaatcagagggcggaggatcagcgtatcagaagcattgtcaatcagccttaagttagttaaagtctggctggatacctgccccaaagcctctccggtcacaattgcctgtacaccgtagcgctctgcaatcctggaagatgccctgaccatcattcttttcagtacaactcccatctggccgtcatccactttttcgaggatctccgcgacaactggttcgaaatcaatagcaacaaaacggactttatgggaactgccaaatcgattccacaaataatgggcaacctgtttcacaccaatttcatgagctgaaccgccaagattaaagaaacagtagtgtacgcggcagccacggcgcatcagcatgtaactggaaacgccggaatcaaacccacccgagatcaacgacagtacatcttcctgtgtcccgataggaaaaccaccgatcccttcatgacgagctttaaccagaatcagtttatcctgttcaatctctaaatttaccgtcacatccggatgcgttaatttcactttggcggattcaatgtgctgattcaggccaccaccgacatatcgttcaacttcattggaagtgaagctatgcttacctcgacgctttacacgcacacaaaatgtttttccatgcagcaaatggccataggcttcgtaagcttgttcaaaaatatgatgcaagtcacgaaaatctcgctcttctacttgcaggatatgatgaatacctgggatacgtgttagtgcatcacaaatttctccaccaaggttatcatttttagctcgaacttcgatattatcccagtggcggacaacagcaatctcctctgataatgttttcagcacattgcggatattgctggcaaggattttaataaaacgtaaccggacggtctggctcttaatcgtaatttctgggaataatttaatgataaacttcatagtaagatatagtagtcattcagtattgaactatcacaatcaatatcaatgattgttcttaagtgttcagttagatagggcgtagagtataacaccaatctcactatatcgactgtaaaaaaacagcggtaacgaatgatttatttcttccagtgtagtagggtactctgcaattctgtagcgaacttgcttgactgtaattcgttaaataatcataccttaaatcattatgcctaaagcaaatcaaacatcagaaatcgaacagacaccagcgtttgagacttccctgaaagagctggaggaaattatcactcgtctggaatcagggaaactccccttagaaagtgcattaaatgagtttgaacgcggtattcaacttgcaaggcagggacaaaaaaccctccaacaggcggagcaaagagtgcagattttattgaatcatgatgcacaatcgccacttgatgaattttcgcctgacgctgagtaaatttatgtctgaacaatataaggctccttttgaagagcatttaagcgcttgtcagcaacatgtcaatgacaagctgatggcaacattttcttcattaccttttttggacagcccattagcgacagctatgctgcatggcgcggtactaggtggcaagcggttgcgcccatttttggtttacagcgtaggcgaaatgtttggcctttccagagagagtcttgatgctcctgctctcgccttagaatgcattcatgcctattcactgatccatgatgatttgccggcaatggacaacgacgatttacgccgtggtcaacctacctgccatatcaaatttggtgagagtctggcaattctggctggagatgcattacagtcattggcatttgagatactggcaaagcaagatatgccaaatattgccttatccgatcgccttgcaatggttgctgaactggcaacagcgagtggtcttgctggcatgtgcggagggcagtcactggatttggaagctgagggaaaacagatcgaccttgctactctggaacaaatccatcggcataaaacaggcgcattaatatgtacagccgtcaggcttggggcttacagtgctgggcaacgtggccgtgaagtactccctttgctggatcaatattctcaagccattggcctcgcatttcaggtacatgatgatattctggatgtcattggcaatacagacgttatcggcaaacggcaggggaacgatcagcaacttggtaaaagcacttatcctgcgctattgggtttggaacaagccaagaaaaaagcgagggatctctatgaagaagcgctcgccgcactcactgaactggaaaaacaatcctataacaccgtgatcttaaaaaaactggctggttttatcatcgaaagaaacagttaaaaaagtgagccataacaatcagcaatcatattagttactagttacattaatcactggttatattattcgtcgattataacagcaatccaataatcaataaaatggcctcatgaggcgaacccagaaattacacactgataacaacagggttcttaatattcaacttctaacgggatagcattttaacgggcatagcatgagcattgatatagcgaaatatccaacattggcattggcggaaactcccgaagaacttcgcctgctacccaaagacactttgccaaagttatgcgacgaactgcgtcaatttttgctcaatagtgtcagtcgctccagcggtcactttgcttccggcctcggcactgtcgaattaacagtcgcacttcattatgtttataaaacaccgtttgacaatttagtttgggatgtcggtcatcaggcctatccgcacaaaatattgaccggacgccgtgatcacattaacactattcgtcagaaaaatgggctccaccccttcccttggcgagatgaaagtgaatatgacaccctgtgtgtcggccattcatccacttcaattagtgctggattgggcatggccattgcggcaaaacatgaagacaaaggccgcaagactgtctgcgtcattggtgatggagctatcactgctggcatggctttcgaagctatgaaccatgcaggggatatcgatcccgatatgctggttatcctcaatgacaatgaaatgtccatttctgaaaacgttggcgctttgaataaccatctggcgcatcttctttcaggcaaattgtatacaaccctgcgtgaagggggcaaaaaagtcttttccaacttgcctcccatcaaagagttactgaagaaaaccgaagaacacctcaaaggcatggtcgttcccggaactctgttcgaagagctagggtttaactacatcggccctgtcgatggccatgacgtattggcactgacccagaccctgaaaaatatgcgtgagctgaaagggccgcaattcctgcatatcatgaccaaaaaaggccgtggttatgcacctgcggaaaaagatcccatcggttggcatgctgtccccaaattcgatccggctacaggttccttgccgaaaagttcagatacccgcccgacattttccaagatcttcggtgattggctatgtgaagaagctgcccatgataaaaaactgatggcgatcacccctgccatgcgggaaggctcaggtatggttcgtttctcccgcgaataccctgaacaatactttgacgtggctattgccgaacaacactcggtcacttttgcggcagggctggctattggtggttacaaaccgattgtggcaatttactccaccttcctgcaacgtgcttatgatcaggtgatccatgacgtcgccatccagaatctgcccgtgctgtttgccatcgatcgtggcggcattgtcggcgcggacggacagacccatcaaggtgcattcgacctctcattcctgcgttgtatcccaaatatggtgatcatggcacccagtgatgaaaatgagtgccgtcagatgctgcatactggccatcactatcagggcggcccggtggttgttcgttatccccgaggaaccggaacaggtgctgaactccagccactggaagcattgccaatcggcaaaggtatcgttcgccgtcagggagaacgcattgccatcctgaacttcggaacactgctaccagacgcattgcaatccgccgaagccttgaacgcaaccgttgttgatatgcgctttattaaaccactggataaccaactagtgctagaaatagccgccagccatgatatgttggtcactctggaagaaaacgccatcatgggtggagcaggcagcggtgtcaatgaactgctgatgcaaacaagtcagcctgttcctgtattaaacctcggtttacctgatcactttatccctcagggaacacaagaagagatccgagctgatttagggttagatgccagaggaattcaacacgctatcgaaaaatatctggctaaataatcttcaaaaaaggatgtatgctctttgcagcaacgcatccttttttcttctgctctttcctttcccaattcaaaatttttcaaaaaactaatcagttatatcaatcttcagtggaagaagtgatcctgagcggtggcgatcccttaatgctgacagataacaagctgaatgaatcattggcctccatccgggaaatccgcgatgacctgctaatccgcattcattcccgcgctttgaccttcaacccttaccgcattacagatgctctgatagaaacattgaaaaaataccgcatcaatgccttcggtgttcatgtctgtcatccatttgaactcagcgaagaatttcaaactgccgttcgtcgcatccaaagtgccgtaccgattgttttttccaatatgcctttcctacgtggtatcaatgataacgaaaaaacactccacaagctgtttatcgatctgtatcgcatgggcgtaaaaccctactatctatatcactttatgcctttctcaccaggttcttctgaatataaagcctcgatcaacgatgccatctctatcatgagtaaactcaaacgtcgcatttcaaatatcgccttaccggaatacgttctgccgcatatgaaaggtaaatttactgttcctctgtttactcatccacaagagatgccctattttgaaaccctcaatggcaaacgttattaccgctttatcaactggcaaaacgaacaatgtgaatggctggataactaagcgttagctacttttctcactgtcctataaaaacgaataaagcttatttattttaaggatgccaaatgaaaccaaacgcaattttgtttgttgatattgatgatgccgaaatcacgcgatatacctatcgggaaccgcactttaccgcagcaaaagaaatggggctgctttgcctgaccgcagcactacaaggacgccagtatgcagaacgtctttccgctgatagtgacgaagttttttatgtagaatcaatgacattgaatgccttgcgggatctagtccacgatttactggatacctacaacctgcgcgctattttatgccatgcaggccatgcctctgccagtgggcaagtcggctgtattgttgccgaaatatgtcaggaaatggagttatcgcactcttcttccaatgccattgccgtctgtaacaataaataccttatgcgtcagatactgaaaaaacatgatatccgttcagtacgctatgcattgtgcaataacgaagaggaactatcttatcaagccaatatgattggctaccctttaatagcaaaacctccctttggggcgtgctcagtctttatcaaaaaatgtaacaactgggctgaattacaggttcattaccaaacatttacagcccactacgaacattctaactacactgattttatgggtaaccaacaagaatacgtgacgcctaaaggtgaaaaatacattagcattccaggaaaaagcctgctgttggaagaatatattgatggtatagaaggcacgattgagtgtgtcattaaccaacacactatatatccagtcttgatcaatgaaaaattgattctgacagagaaaagcaacaccgtgctggaaaacctactcattactccacctgtatcattttcaccatcagaacaggaacaaatcaaaaactacgctatagcttgccttaatgccgttggtttaaacaatgcaattgctcaccttgaatttcgtatgacttccgaaggccctgtcattattgaaataaacccacggctcggagggctgtttgtcaactcggctttccgtgatcttgcaggcctgaacccttatcagctttatctttctatcctcatacaagatcaagaagttgattttcaacttacccaagcttgcaaacaagtagaacaagccacacaacattactcaatgattgttatgtatccagatacaaacggtcattttaaaggcatcgaaaaccttcactatctcaaaaatcagccatgcatactcgaatgtgtatcttatgccaatgactgctatatcaacgcggaaattgaagaacattatctgattaagtgctgggcaaaagtcgaaggagcatcccatgcccatacgttgcacagcaatatgctagaaaacgtcaaacccatcattattccagaatctgatttgatttcatgaggctgctacacgatgaacattacgaatatctcagcaaatttaataaacgaacattattgccatattccacatttcagtaaattaatttcctgtgattcaaaagcaactaaaacgtttaaaaaccattgggataatctggttctggatcagaatttcaaagactatacccacagggagaggcgtattctgcgttaccactatcgccccggcatagaaatcccctttcagctcaatcaagatactgaatatcgatcatcagtaacctatgacattgaatacaaaaaaggtgctaatcaactcagttatgctgaagatacatttattaacgatccgatcatgcagcatattctttcaatggatattgctattttaggtgatcgattaataaaaggttgccactattcgattgatattcatcaatttcgtgttaaagcgtttgctgggaaagaaagcccaacgacttcaggtattcatcaggacggacaggattggatctttatgcattttattcaaggccataatattgcacctgttatttccgaggttcatgcaaccacagatgaaacgcctcccttgctgcataccgtgatggaacaatttctagaaacactcgcaataaatgacagacaaccttatcatcgagcaagcaatattcgacaaatatctcctacaatcacggcatttcgggatctgttgctggtgactttccggcaatgccctgaacaacaagagagctaataatgtcaagccaggaaaatagtttgaatttgcgttggtctggcctaaatgccttgctgatcgtcagtgcacgattcgtatctgattttggcgcattcctgaatatggttgcgctatccacctatgtttacctgcttagtgatagcgtcatgcacgtcagtatttttctggcctgccgtgttgccggcgggatcattgccagcctgataggtactccattcttcaggcgatttgccggacgctggccactggtctgtttcgatttattgcgggtcattctactatccctgttattggtgataccagcttcacagcagttactgatcttaccgatgatcgctttcggcattggcttaggcaactcgacgtttgccatcggactgaacagccaactcccttactgggtacacgcttcccaacgcatatcaaccaactcctggctaacatccgtcgccgccacgggcgcagtacttggcagtttggtatccggtttgttggtcgccagcagtggttatgaaatagtctttatcgtcaatatcattacctacctgctggccgcattcttgattatgcctttgcgtttcctcacccatcctgaacagaaaacatcgcgggaacggggtaacgaatggcgtgagttaatccgcggcttacgttgtgctccgatgctggcaggaatgctgttcctcagtttggccgacaccctcggcagcgccgcccataacgtgggatttcctgtcatttctaagttacttacgccagataacgccagtaccacaatgggcttactgctggcgacatgggcggtgggaaaattcagtggagcgcgtctgaccagctacctgctacgcaaccgcaatttattgaagatggagaaactcttttttctgggcgttgcgttgatgtcgaccggatttatccttactttccaacaaaccagccagctttggctgctcgtgtttgcggtctgggcaggtatcggagacggaatagctgaagtcagcctgatttcacgggcgcaaagtgaaccggaaagtttacgcttgccgattttcagtttgctgacactattacagatgacgggctttgggataggtatgttggtggtggcaccgttttacgtctggtatcccccttccatcgtgatcctgatatttcacggtttgccgcttactgtgctagttatcatcctaatctggatccggcgttttactacaaataaagtgtaagcctcattgtagttatcaatttaaaaaccagcaccgaagtattctatattgcttttcgctgctggttttcctcaatgaggatagacaaccccgccagcttgccatcaccaactgatttaagggggaaagcatatctggccaccccagcctaatatataggttattaaatacgtgtagaatctccaatttcgtataacgatgttgcacttgtatcataataattatggtgatcagcttattatgtaaactcacctaagtttataataaagaaaattacctttataagttgaagataattacatccaccaaaacacaattataacataaatagatattgttaaaaattacatcccaataatgctaaaaacaaaattcacgataccacataatcatttaccaaaaatataatctacatatcattaatatgaatttttcattcttaagcatcgatactctataaatttcgagttacagttaacaaaatatttttgggaaataaactatttttcattcaagaagtgatctgcattccatttttacaatccaattcgaattttctttgcttaatccttaatcacaatctatttattgttcaacaatacaaaataattaattaacaataatggtaatttaaaccaacaatatgacaacgtatttcatttattcaatggggaaataaagtatgcagcaagccatcaatttctggccactgatcgggattgccgtcattatgatcgggtttatccttcgttttaatcctgttttggtcgtaacggttgcagggctagtcacagggttagccgcccatatgccaatcaccaaaattctggaaaaacttggctccggatttcttaataccttgaatctaccactgactattttgctccctttagtcatcattggccttctagaaaggcatggcttaaaagaacgcgcccaacgctcgattgcccatatcaaaactgccacaactggacgtttactgattgtttatctgtttatacgagaaacttctgccgcgctagggctgaccagtttaggcggccatccgcaaatggtacgtccactactggcaccaatggctgaaggggcggcagagaaccaatatggtcatttgcccgatcatattcgccaccgtattcgcgccatgtccgccgcaactgataatactgggctgttcttcggggaagatatttttgtcgccttcggtgccattatttttatgcacaatttcatgctggaatctggtggtatccagactgaacctctgcatattgccttgtggggtattcctaccgccatttgtgctttcctgatccactcggttcggttatatcgccttgattactatcttgcccgcgaaattacttccctgaatcatatggaattgactagcaaggaggcaaaataatgtttcagttacagtatctctactatctggcgggattcattttgctcgttgtcgccgtgatgtcgtggcgcgatcgagccaatcctcgacgtttgaccacaggcctgttctgggggctatatggcctcatcttcctgataggaaactggagttatcaattgatggctatctggataagcgacgaagatcaagcccagaaaatcgtccatatcagtgttggtacgctagtgattatcatagcgttattggcaggatttggtggagtacgtttgggaaactaccatcagcctacaacggaacaaaaacagaaaagtgcagaacgcctcggcaatcggttatttttgcctgccctgctcattcccgttgtcacgatagtgggtgtcctgctgtttaaccatattccgggactacagcaaaccgttttcggtgcagacaatcattcaacgttggtgacgttattttccattgccctcggttgtctggctgggttaatcatcgcattgcgcatgaccagagaaaacatcatgcaaccgatacaggaaacacgccgtctattggattctatcggctccgtgtttattctaccgcaaattctggcaaccctcggattactgtttacggcagcaggcgtaggcaccgttatttcttatctgactgaaaattatctggctgtcgataatcgatttatagcggtgatagcctatgttctcggcatggctgtactgactatgatcatgggaaatgctttcgctgcctttcctattgtgacagccggtattggtattcctattttgatcttgcaacatggcggtaatccagccgtaatggcagccatcggtatgttttccggttattgcggtacactgatgacacccatggcggcaaatttcaatctcgttcccgccgccctgctggaattacctgatcgcaacgccgtaatcaaggctcagatccccaccggatgcaccttagtgcttactaatgtgtttttactctactttctgatgttcttgtaaaacaacaatacgaaacgattatgaaaactattttagtcactgcttttgatcctttcggtggtgaagctatcaacccatcgtgggaagcaatcaaaccattacaaggcagccaagtttttggtgcaaatattgagatttgccagattccctgcatttttgatacttctttagaacacctttatgcagccgttgataagtatcagcctgaactggtgatttctgtcggtcaagcgggcggtaggacgaatatcaccgtagagcgtgtcgctattaatatcaacgatgccagaattcctgataatgccggcaatcagccgattgatacccccgttattgttgatggccctgccgcctatttttctcgtctgcctattaagacaatggtcaatgcattaaatacagcaggtattccggcgtcagtttcccaaactgccggaacctttgtgtgtaatcatgttatgtatggcttattacattatctggctcagaatactccctctgtacgcggggggtttattcacgttccttatttgccagaacaggcggtaaaagatggtaatcaatcaagtatgacgctgatgttgatgacgttggcgttgaaaatagccattgaaacagcctggaaaaatacatcagatattgctgttacaggtggagctactcactaaaaaaagaggtagactcgaggcgataaaaataaattagccactgagtacaatggctaatcaattattaaacaacaataaaagtgagaattcagaaaggtaataatgggtagaaattcagcaaccaaataacaataactgcgaaaattgccgcaataatgtcatccagcatgatgccgattccacctttgacatagcgatcgaaccagcgaatcggccatggtttccacatatcgaagatacggaataccacaaaagccaccaaaacccactgccagttgaggacgggaatcgccatcaatgtgatccatatgccgataaattcatcccagaccacacaacccggatcttccacctgcatagcatcggctgctttctgacaaatcacgcagccaatcaccgttcccagcagaataaccaaccaaatgccccattcaggcaactgcaccaacaacaaccagaacggaattgccgccagtgagcccatcgtacccggcataatcggcgataaaccgctaccgaaacccgtagccaacaaatgccacggattccgcatccttaagcggcgttttgcatcatccatgagttccctccgtctgatcattctgtgtctgttgtgatacctgacagactgctaacggttttttttcaggcttaaaatggtcgaagcctttcagatccagctcaatttctttatttttgttaaaaaagcggatgccttctgattctggcctgatttgtccaatacagcagaaactggcgccggtatgtgccaatgccatatttaatgcaccacggttaagttcaggtacagtgaagcacaattcataatcttctccccctcccagcgcccatgttaatgcctgctctggtgtggcatatttctggacagcctccgaataaggcagcgcatccagattaatacgcgcaccacattggctggtggtcaaaatatggttgagatcagaaatcaaaccatcggacaaatcaatcgcggaagtggccagatcacgcagtgcctgcccctgtaaaatccgaggctgtggacggagatgacgtttaaccagccagttgtggatagcggtatcttccaccgtaaaacgatcttgcaacagtgcaagcccagcagcactgtcacccaacgttcctgtcacataaatccagtcaccgtttttcgcaccagcacggcgtaacgccctgccagcaggcaccaggccatgtaccgtcagcgtcaggctcatggggccttttgtcgtatccccaccaatcaactgcatgccataatagttcagttgttcaaacagactatcactgaaccgcttcaaccaatcctcattgacatcaggcaacgttaacgccagtgatgcccaagccggatctgccccaactgcggccagatcactgatgttgacagccagcgccttataagccaaatcttccggggaaatgtcagggaggaaatgaacaccggcaaccagcgtatcggttgttaccgctaattcttgtttctctgcaacggtcatcaacgcgcagtcatcaccaattcctagattcacatcacgtcggcggatgacatggcgattgaaataacgtgcaatgagctcaaattcaccacatgccataatagaattccaaaaagtgactaacgatgagcacatgaggccggaaaaccggcctcatgtgtaaaatcatcgagttataatggggaactcctggcaagcaatcactttttcttgcgtgctgccgggccagctttatccaacaccccattcacgaatttatggctatcttcagcaccaaacgtttttgccagctcgataccttcattaatagccactttataggggacatcatcacgaaagcttagttcaaacatcgcaacgcgcaagatggctttttccacctgacctaactcttcaagctgacgggaaaggtaaggagccatcaaagcatccaattttgcagcattgaccgctaccccagtcagcaattcacggaaataggtgatatcaacaccggttacgtcctgctctgacaaaaactgaaattcaacatcagcaatgtcatttttggataattgccatgaataaattgcctgaacagcacactcacgagcacgacgacgagcagcaggtttcacaaaattccccttaattaaaactaaaaaattcagcctttaatggctttgattacattgatcatttctaatgcggtcaaggcagcttccgcgcctttattgcccgctttagtgccagcgcgttcaatcgcttgttcaatactttcggttgtcaaaacaccaaatgccacaggaatgtcactggacatcgctacgctggacagtccagagctgcattcacccgcaacatattcaaaatgggctgtaccgccacggataacggttcccaaagcgataaccgcatcatatttttgagtctcagtcagagccttaaccgttaacggtaattcataagcacctggaacccagactacagtgatattgtctgaagaaacctgaccgatgcgttccaacgcatccaaggccccttccagcaggctgtcattaatgaagttgttaaagcgggcgatcgcaatggcgatgcgggctttaggagctgcaacaacacctttgattacgttcatagccttccttataccttattcatatccgcaggggcgcggatcttatcacattctttttctctacgtcttgatttatgtccaaacttgaatcaagacgctggccgcaagcgaagacgcacatcagacccaatctgccggacatcaaacagcgtgaattcaggcgcatccgataatttttgtaactcagggatagcaaacagcccacgggcagtatttcccagcacttttggtgctatataaaggattaattcatcgactagccccagtgataacaatgctcccgccaaaacaggcccacattcagcccaaaccgaatttatctgacgtttaccaagctgcatcatcagcaaaaccagatcaacacctcctccgtgggcaggcaatacaatatgatcgacattgtcaggccactgctgctgatcggtgtgagtacgtgctaaccaacattgccccacctgctgtacaacttgatgctgtggtgttacgcgattctggctatcaacaatgatccggattggctgacgtacttgctcttgaggataaatcgcctgtatttcggcatccaattcatgccagcggacagttaatgaaggatcatctgccagtaccgtggcactggaactgagaatagcactgcattgcgcccggaactgctgcacatcctgacgggcttctggcgacgtaatccacttgctttcacccgatgccagcgcagtacgtccgtccagtgacgcgcccattttcagttgcaaataagggaatcccgtgcgcatacgcttgagaaatcccttattcagcgcttctgcctccgccatcaacacgccatgctcaacggcaatccccgcctgctgcaatttatacaaaccacgccctgcaacctgcggattaggatcttgcatagcggccacaacacgactgataccggctgcaatcaacgcatcggcacagggaggcgtcttgccgtggtgactacacggctcaagggtgacataagccgttgccccttttgccttgcctccggccatgcggagagcatgtacctctgcatgaggttcaccggcacatacatggaaaccttcaccgacaatgtgatcgccctgaacgatgacacatccaacattcgggtttggagatgtcgtaaaacgtccctgattcgccagttccagcgcacgggacatatatttttcatcgagagtcatagtttttgaaagcctgattttttgaaagccagcatattcaatcttgtagtctggcaatttcttcgccaaattcgcgaacatcctcaaagctgcggtaaacagatgcgaaacgaatataagctactttatcgagctttttcagcgcatccatcacgaaattcccgatcatcttggatggaatttctcgttctcccgttgccctcacttgtgacttaatatggataatcgctgtttccacatcatcagagctgacaggacgtttttccagtgccttcaacatgccgcgacgtaatttttcctcgtcgaaaggctcccgaatgtcatcacttttaatcactcttggcatcaccagttctgcgatttcaaacgtggtgaatctttcatgacattcgagacactgacgacgacggcgcacttgggagccatctcctaccagacgggaatcaataactttagtatcaacggctgcgcaaaatgggcaatgcatattgtttcctgacagttaaccgaacgggaagacagtttaccttgaagtgataatgaaaaacaccctgtcagtaagtactcacagggtgtttaaataaacgatatcagaactagatcgtatcaggctattaaggaagaatggaaggctgatccgccccttctttctcaactttctgctgaatcatatgctcacgcttcattcccagtttcaaggccagtgcagaagcaacatagatagatgatatcgtaccgatggaaaccccgattaacatcgccagtgagaaacctttcagcatttcaccaccaaagatgtaaagcatcagaacaacgagcagcgttgtcgctgaagtcatgatcgtacggctcaaagtctgagtcagggaaacattcatgatttcatacggtgtgccacggcgtatcttacggaagttttcacggatacgatccgataccacaatactgtcgttcaatgaataaccgataacggacatcaacgatgccacgatggtcaggtcaacttcaatgtggaataacgacagtacacccagtgtaatgatcacgtcatgcgccagtgcgataacggctcccaatgccagacgccattcaaagcgaaaaccgacataaatcaggatgctaattagcgcagccagcagagccattgctcccgtctgcgccagctcgcttcccacacttggcccgacaaactcaacacgcttgacgactgcatctttgtcgatattcgcgttgataaccgagataattttattacccagttcctgccctgcattgcccgtcacaggcggcattcgcactatcacatcacggctactgccaaagttttgcagaagcggatcggcaaaaccgtttttcgtgaggctttcgcgcatcttatccagatcggcgggtttactcaggttaatctcgattaccgtaccaccggtaaagtccagcccccagttaaacccacggacacccatcgtaatgatggaagcgaccaacaacagtaacgaaatcccaaaggcaacgttgtcccagcgcataaagtcgatgactttacgcccatagtttaattgttcaacagtgtaatcctgtgccacaacgtgctccttaaattgacagcttattgatacgcttaccgccgtacagcaggttcacgactgcgcgtgttcccacaatggcagtgaacatcgacgtcgccacaccaatgctggtcgtgatcgcgaagcccttgatggagcccgttcccactgcatacagaatcacagcagtaatcagcgtagtcaggtttgcgtcaatgatactggaaaacgcacctttgtagccttcatgaatcgcttgctgcaccgtacgcccgttacgcagctcttctttgatacgttcgttaatcaaaacgttcgcatccactgccacggcgagagtcaatacgatacccgcaatacccggcatcgtcagcgtcgctcccggtaacaaggacatgacaccgacgatcagcactaagttagccagcagagcactgctcgcaatcaatccgaacttgcggtagtagatcaccataaacaggatagaagaaatcaagccccacagacaggcttcaagcccctgcttgatattctgtaagccaagggttggcccaatagtccgttcttcgacaatctggatgggtgcgatcaaagcacctgcacgcaacaacagcgccaactgacgggcttcattcaggttgccaattccggtgatacggaaactattgcccaaacgagactgaatggtagcgatattaataacttcttcttgcttcaccagaaccgaacggccattggcatccttcttgccactgtccttatattctacaaacagcgtagccattggcttttgcaagttgtctttggtgaagttagacatcgcactaccgccagcaccgtccagagaaatattcacctgcggattaccgtattcatcagtactggaagtggaatccgtaatatggtcaccagtcaggatcacgcgcttgtataacacaaccgggttgctatcacgggtatacttcagttctgaatcacccggaatccgaccagatactgcggcactctgatcaacattactgtttaccagacggaactccagcgttgccgttgcaccgaggatttctttggcacgggcagtatcctgaatgccaggcagttcaacgacaatacggtctgcgccctgacgttgaaccagcggctctgctacacctaactggttaacacgattacgcaggatagtgatattttgctgtaccgcataggttcgagcttcacgcaggcgatcgtcactcataacgactttcagcgtactattcgcgccagtggagaagactaaatcacggtgacggggttcaagataactttccgctttggaacgtgcatcattatcgcggaaacggacttccactccatagttatcaagcttacgaacagaggaataaaggatgccttgatcacgcaattcagagcgcaggctatcaatattctgttcttgtagcttactcagtgcggtttccatatccacttccatcaggaagtgaacgcctccacgcaggtcaagccccagtttcattggctcagcacccactttacttagccaaaggggtgtcgcgggcgcaaggttcaatgccacgacatattgttctcctaatgcggaaaccaatgcttcacgggcacgaagttgaacatcagaattattgaagcgagcaagtattgctccattttccagtgcaatggacttgctcttgatttgttctttttctaaaacattacggacttggtccagcgttttttcactggcggcgatgccccgcgcgccagtaatttgtacagccggatcctcaccatataggttgggaagtgcataaagcaaaccgatgaggatcgcagcgatcagcatcagatacttccacaaaggataacggttcaacacggcagttcccttcgggaaaatcggaaaatcaaatagccttcattgtacctttcggcaaaatggcagcgacgaaatcacgtttgacagttatttcagtagtgtcattcaaagcaaccacaacgtaacctgtttcagacactttagagacacgacccactaaaccaccagaagtcagcacttcatcacctttggcaatggaatccatcagttttttatgttctttggtgcgtttttgttgtggacgcaggatcatgaaatagaaaatcaaaccgaaaacaaccagcatgataatcagagaatatgggcttccctgagattgcgctgatgcaccagcagatgccgcagcgtcagaaataaaaaaactcatcaaatttccctcattgttatcgaaaacattgttgtcaaaaatcgacagtggcttgatcaaaaaccagcccagtatgctacacatattgaggctggttagtcacgccaaattatatatttaacgacggaacgggtttgccaatccgctgataaaactcttcaacaaactgttccagtttgttctcttcaatggctttacgaattccggccatcaaacgctgataataccttaaattatggattgtattcagccttgcaccaagaatttcgttacagcggtcaagatgatgcagatatgcacggctataatggcgacaagtatagcaatcacaatgctcatccagcgtagaagtatcttccttatgtttagcattgcggatcttgatcacaccttctgtcacaaaaagatgtccattacgagcattacgggtcggcatgacacagtcaaacatatcaataccacgacggacaccttcaaccagatcttctggtttaccgacacccatcaaataacgtggcttatcctgtgggatttgcggacaaacatgctccagaatacgatgcatatcttcctttggttctcctacggccagaccacccaccgcgtaaccgtcaaaaccgatttcgaccagtccctttacagaaacatcacgcaaatcttcgtacacactgccctgaataatgccaaacagggcatttttattgcctaactcgttaaaacgctgacgactgcgcgccgcccagcgtaatgacatttccatggaacgcttcgcataatcccaatctgcaggatatggcgtacattcatcaaaaatcatgacgatatcggaacccaaatcatgttggatttccatggatttttccgggctgaggaaaacgggcgtcccatttataggattacggaaatgaacgccttcttctttgattttacgcatcgcaccaaggctgaagacctgaaaaccgccagaatccgtcaagataggaccgtgccactgcataaaatcatgcaagtcaccatgcagtttcatgatctcctgcccagggcgcagccataaatggaaagtattccccaacagaatctgagcaccggtttctttaacttcttccggtgtcatgccttttactgtgccgtaagtccccacaggcataaatgcaggcgtttccacaacaccacgttcaaaaatcaggcggccacggcgagcattcccatccgtcttttgtaactcaaatttcacttaacctccagacatcagaaaaacagtctgatgttatgtttaaacatcgttcaaaccagccaagctggaattacgagactttctctttcgttgccatagggttgcgatgaataaacatcgcatcaccataactaaagaaacgatacttttcggctaccgcttctttataggcattcatggtattttgataacccgcaaatgcagaaaccagcataataagcgtggattccggcaggtgaaaattggtaatcaacgcatcaacgacttgatactcaaatcccggataaataaagatttgggtgtcatcaaagaatggctcaatcagaccattctgacaggcacgagccgcactttccaatgaacggacagacgttgtacccacggctacaaccttattgccacgcgccttacacgccaataccgcatcaacgacattttgcggaacttctgcatactcagcatgcatgatatggtcttcgatagtctccacccgcacaggctggaacgttcctgcgccgacatgcagggtaacaaaagccatatcgacgcctttttcacgcagtgctgccaacaggggttcatcaaaatgcagcccggcagttggtgccgcaacggcaccagggcgttcactgtagaccgtctgatataactcgcgatccgactcttcatcaggacgggcaatatacggtggcaacggcatgtgaccaatttcatccaaaatggtcaatacatcacgatcatcatcaaaacggatttcaaataaagtatcgtggcgtgccagcattgttgccctgatgctttcatcttcgcccagcagaagctctgcaccttctttcagtgccttggacgcacgaacgtgagcgagtactcgcttattatccagcatcctttctactaaaacttccaatttcccacccgtcgccttgcgaccaaacaaacgcgcaggaataactcgtgtattattgaaaaccagcaaatcaccggcttccagcttatccagcacatcagtgaaaataccgtgcgtcagccctccggttttgccatcaagggcaagcaaacggcaaccactccgctgcggctggggataatgagcaatcagctcttccggcagttcaaatgtaaaatcagcgacacgcattttatctgtatcattcaaaaaaacaggcggactagtctagtgccgcacgcgcaagggtgcaacaaagaagcatattagtttcactatttccggtatactctcgctatgaattttctcgcacatcttcatttggctgcattatcggaaagttccttactgggcaatttaatggcggattttgtccgtggctctccaaaaggattattcagccccgatattgtagaaggtattcgcctgcaccgtaggatagacagcctgacggacagccatccatgggtcaccgaagcatgcacactgtttcgtagcgagtatcgacgcgtagctcccattacccttgatatcatctgggatcattttctttctctgcattgggacaagcttgaaaaaaattactccctgcctgaatttgtacatcttgcccgtagtcagatagagccgcatcttagcttcacgcctgaaaaatttcaggcgttgaacaaatatctctggtcagaaaatctacttatccgctatgccgatatgtcatgcattgccaatgtactgaaaggcatggctcacagacgccctaaattatcggcactggcaggatcgtatcaagatatcgaaatgcattatcttgattttgaagcgctattttggaaattctatccacacatgatggcactggcgaccaataagcgactgcttgagcaagatatttcgccagaaccttgcactttttccaaatagctttatcttatttaggctaaaaggaattaaaagcaaattattgataggcaaaatctattatatcaattggtattttatcctttattgctttaccttaattccttatgctgtaacccgtttctacataacacctttttaaaatcacaggagtcaattatggttctagtaacccgccaagcccctgactttacagccgcagcggttctcggtaacggtgaaatcgttgataatttcaacctgaaaaaccacctgaatggtcgtccagccattatcttcttctggccaatggacttcacttttgtttgcccttctgagctgatcgcgtttgatcaccgttatgaagaattcaaaaagcgcggtgttgaagtcatcggcatttccttcgactctgaattcgttcacaacgcatggcgtaaaaccccaatcagcgaaggtggcatcggcgaagtcaaatacccaatggttgctgacatcaaacgtgacatcatgaaatcttacggcattgagcacccagaagccggtgttgccctgcgtggttctttcctgatcgacaaaaacggtgttgttcgtcatcaagtcgttaacgatctgccactgggccgtaacatcgatgaaatgctgcgtatggttgacgcactgcaattccacgaagagcacggcgaagtttgtcctgcacagtgggcaaaaggtcaggaaggtatgggtgcgtcccctgaaggcgtcgcaaaatacctgaccaaaaacgctgataaactgtaattcccgtcagagttgtctccattgatagcatcacgttattaatgaattcccctaaaccagccactctgtcggctggttttttcttagctaaaatttctcattttattaccttgcgcacaaaaaattgcttttcaaaaatcctaagcgttagataatgttgattacaaaaaattaacattggtatcacagttcacggagtcctaccctaaccactcattcttaggagtaccatcatgttaaaagcatggaaaatgccttttgtcgctgtatcgctcttagtttcctcctccctctatgccgcttatgaacctgccgttgaagccaaacaaggcatggtagtcagttcacaatacttagcttcacaggttggcgtcgatattctcaaaatgggcgggaacgccattgatgccgctgttgccgttggttatgcccaagcagttgtcaatccctgctgtggcaacattggtggcggtggtttcatgaccattcatctggcaaacggcaaagatactttcattaatttccgtgaaacagcacctgctgcggccagcgccaatatgtatctggacaaagacgggagtgtcatcaaaggtgccagtctgtatggctataaagctattggcgtccccggcacagtgatgggattagatgccgcactgcacaaatacggctcaatgacccgcgaacaagtcatggcaccggctatcaagctggcgcgtgaaggctacattttgactcgtggtgatactgatattctggacaccaccgtcaaacgctttacccaagatccagaggccgcccgtattttcttgcgcaaggatggtacgcctttccaacccggggataagttagtccaaaccgatttggccaatacgctggaactgattgctaagaaagggccagatatcttttatcatggcaaaatcccccaattagttgaagaatcatcgaaaaaatcagggggaattatcacagcagcagatttcgccaactataacattacagaaacaacaccagtcacttgcagctatcgcggttataaatttatctcttccccaccacctagttctggtggcgtcaccttatgcgaaatactgaacattgttgaaggctatgatctcaaatccatgggattcaactccgctgcttatatccatacattgacagaagccatgcgccacgcctacatggacagaaatacctatctgggcgatcctcaatttattaagaacccacttgatcggctgttaagcaaaagctacgcagaatctatcagaaaagagatcgaaccaaacaaagcgacatcttcaaaaaatgttcagccgggcgttggtccccatgaaaaaccagaaacgacccattactctgtcgtagataaagatggcaatgccgtatcaaccacttacacaatcaacgggcgttttggggccgtcgtgattgcaccgggaaccggctttttcctaaacgatgaaatggatgatttcacaactaaagttggggaaaaaaacctgtatgggcttgttcagggagcgaccaactccatcgcccccggtaagcgcccactatcatcgatgagcccaacactcgtgaccaaagataacaaaatctttctggtattgggttctccaggcggatcacggattatctccatcaccttacaggctgccttgaatatccttgattttggcatgccaccgcaagaagccgtcaacagcccgcgcattcaccatcaatggctgcctgatgaagtctactatgaacagcgtggactttcgaaagatactctaaatatgctggaaaaaatggattacaaaatggtagaacagacaccgtggggcgcggcggaactgatcatgattggattgccgggtgctgtcggtgtctctcccaccaactcatcaggcaatgattcagcggtatcaggcgtggttcgtgaaggttatatctatggctccaacgatgtccggcgacctgctggtgcagccattggctactaaaaaagcagtgtaaaaggttgagataaacaaatcgatataaaaaacaagggtgagcagtttgatatgctcaccctttttacaggtttcaggctatcagccttgatcctgctgcacttcacgctttgggactttgctttctcccacaatgagatcatagagagcacacacaactacagctagtatcgttggcaataaccatgccagccctttatctgccaacggcagatgaattgcccatgctggtagtaagtgagacagatactcagacgatttcgccgcatccaaaaccccgaacagcaggctaactaccatagcaggcgccagaatgcgagtaacattattccaccagcgtactgtgaagctcaacaggatcagcgcaatacaaggcggataaattgctgtcagtaccggaatagagaatttaatcaagtggtctaatccaagattagagaccaacatagagaagattccgaggatgaaaaccaacgtacgataagataatggcaaataacggctgaaaaattcagcacaagcacaggtcaaaccaaccgcagttaccatgcaggcaacgaaaatcaatacagcaaggaagaaactgccataaccgccaaagacattctgtacataagcatgcagaatcactgcaccattttcagccttcggcaccaatgtgccactactttctcccaacttgaacagagatagatataccagtaccaagcccaaccctgcaatcagacctgcccacatagtatagcgagtcaacagtgaagaagattcaatacctctggagcgcgcagcattgacaataacaatgccgaataccatggcacccagtgtatccatcgttaaatagccattcacaaaaccatttgagaacggaatttctttataagtttgaatggcagggatgggatcacttgctggccacaacaccgcagcaattcctaaaatacccagtgccagaattttgatcggagccagcacgcgtccaacactgtccagtaatttccccggatacagagaaaccaagatcaccagtgaaaaataaacgatactatagatgaacaacggaagtttgccagagcccattagcggagcaatcccgacttcaaaggaaacagttgcagttctaggtattgcaaataaagggccaacagccatatagcaaacagtagccagtatcaaacctgctgttttaccgataggggaacttagcgcttcaatcccgccaccgactttcgccaaagcaatcacagtgatgaccggtagaccaaccgctgtaagcaaaaaacctagcgcagcgatccaaacattctcacctgcctgcaagccaaccatgggcggaaaaatgatgttccccgcgcctacgaacaaggcaaaagtcataaaacctaatgcccaaatatccttagatgataaacggtatgccataatgattgttaatatattgttgtcaaaagaattgcatgtgcaatagccagtattgcaaatacttgaattttcactggcgaaaccggattctgctttgacaataagtgatcaacgtaatattcactgataatcgggaaatacagaatgatagtggtaattacagctagaatcgccaacaactgcccacaagtaaaacttttatagcgccaaaaggcaagcatcaaaccaaaaagcagtacaatatactaaagtaatatttaaaagcagtcattcttattatctatcactgaatacacactatatgatttgcacttttttcgctcatattgattaataaatcatttttctgtctgcatcgtttaccactaaattatattaaacttattgttttttaattaaattcggtttggcagaaacaataagcccgggagccaataaaaaactaaatgtggaaccttttcccatcgtactcgaaacctcaagatgggtattgtagtgatgcagtgcatgtttcactatcgccagccccaacccgcttccccctgtttgccgagaacgggcacggtcaacacgataaaaacgctcggtcaggcgcggtaaatgctctgcactgatccccgaaccattatcctgtactttaaaccatgctccctgagacgatttactccagctaacctcaatacgcgttcctggcggagtatgattaatagcgttataaaccagattcgacatagcgcttcgcagttgttcttcgttgccgaaaactttcaatttttcatcaatattaaacacgatatcctgctggttattcgccaatgccaacgcttcctgctgcaacaacaccaataagtcaggcacatcaaccacctcgttcatatccacttgcggcccggcttcaattctggagaggtgcaataattgcttcaccagaccgtccattctccgtacctgctcctgcatcgtactgagcaccttctgatttgccctatcgttcagttcctgctcctgcatcatctccagataaccttgcagtaccgttagtggcgttcttaactcatggctgacattagagaaaaaatcccggcgggcattttccaacaatcgtttttgcgtaatatcacgggcaaccatcagtaacatccgttctgcataaggcatcacccgaaattccaccatacggccattattcaactcaatggataaaggacgggagaaatgactggccgtaatatagcgactaaaatctgggtaacgcagcaaattgaagatatgctgaccattatcctccggccagcggaagcctaacaaatgctgggcaagacggttacaccagaaaatattaccttccgtcgtcatcatcacaatcgcatccggcaatgactcagcgccactgcgaaagcgcttgatcaataatgccagttcccggcgccgcttacggttgcgctgctgcaactgataaataccgtaaaagattggctcccatccgccacgccctgctggaggtaacatactgcgatccagccataaccagtcagataatttcaataaattgtagccatgccataccaatgccagaaataacccaataaccagcagccacggtaaatatccgataaagagagacaaaatgaccgcaggcagacaaaaaagaacaagccccaataccaacttcttccaggataaacgttcaagcacgttattctctccggcatgaaaatagattattgccaatcagcaccaatgagaaacagatgcattaataacgagtagaaaagcgataccctgtaccacggaccgtctgcaccattctatcgtgccctcctacttctaacgccttacgcaaacgccggatatgcacatcaacggtgcgatcttccacataaacattagtgccccacacataattgagcaattgttcacgactataaacacgctctggatgcgtcatgaaaaaatggagcagcttgaattccgttggccccatttccacattttgcccctgactggaaacacgatgggaggaagagtccagtatcagcccatccatattgataatatcttccgccgacatgggggaaacgcgacgaagaaccgctttgatacgagccaccaactccttgggagagaaaggcttagtgatatagtcatccgctccgacatcaagaccacgaacgcgatcttcctcctctccacgagccgttaccatcatgacaggaatatctctggtgctgctatcacgcttcatctgcttaataagctgtattcctgaacctccgggaagcatccaatccaataacaccaaatcgggataaggctccgacaagcgccagacagcaacatcatagtcttctgcttcaacggtctgatagccattttgttccaacaccaaacaaaccatttcacgaatctggacttcatcttcaactaccaaaatgcgtttagccatggttgatcccattaatattattgaagccagcaatattcaccttaagtcattatgagtcaattttatgacaaatttatgaaaatcctatttctcaattctcaaactgcaatctattttgcatagaatttatgagtgctttgtcatatttcattatgattgcgagcccgctcgaaaattcgtgaacaaagtcagaattccacacgacagacctcaaacactcattataattagcgcttgaaacagataagcaagactcttgggcaacggtaggaaaacatgcgaatcattcatacgtcggactggcatctcgggcaatatttctttaccaaaaatcgtgccgcagaacatcagcactttttgcagtggcttattgaacaaatcatacggcatcaggttgatgcattggtgattgccggcgatatttttgatactggctctcctcccagctatgcccgtgagctttataaccagttcgttgtggagctacggcccactggctgccagcttgtcattcttggtggaaaccatgattccgtcgccacgctcaatgaatcaaaagcgctattctcttgtctgaatacaacagtaatagccagtgcagacgccgacatccagcagcagataaaagtattgaataacaaaaatggagaagcgggagccattctctgtgccattccttacctgcgtccacgggatatcatgaccagccaggccggtcagtcagccacgcaaaaacagcaggcattgcagaatgccattactgaacactatcaccagctttatcagcaagctgatgcattacgggaaaaactcggccagccattgccgattattgcaaccggacacctgaccacggtgggtgcttccacctcagattctgttcgagatatttacattggtacgttggacgcattccccgcacaagcattcccacctgctgattatattgcattagggcatatccaccgcccacagatcatcgctaaatcagagcatatccgttacagcggctccccgatccccctgagttttgatgaagtcgggcaagaaaaaagcgtctgtctggttgattttaaagaagacaaatttgataacgtcactcttttgcccatcccaaactatcaaccgatgcagttgatccgtggaaatctgcaacagattgaggctcagttgcagacattcaaagcatatcagggagaacgtcctgtctggctggatattgaagtcgcgactcaagattacctgcctgatatccaaaaacgcatccaaactatgactacggatctacccgttgaaatcattctgttacggcgcagaaaggcggcacgccaaatttccctgtctgaaacaaataaagagacgctcaatgaactcagcgtgcatgaagtcttcgaacgacggctagcactggctgagattgaagatcagccccagaagcaacgcctgacgaccctgtttaagcaaacgctggatgatatttctcagcaataatattgaggattcgcgcacatgaaaattcttagcttacggctgaaaaatatcaactctctgcaaggtgaatggaaaattgattttacggcagagccttttgccagcaatggattattcgccatcacaggcccaacaggagcaggaaaaaccaccttactggatgccatctgccttgccctttaccacgaaacaccacggctcggtactatttctgctatccagaatgagttgataactcgtcatactgcggaatgcttggcagaagtggaattcgaagtcaaaggcgtagcttatcgtgcattctggagccagcgccgcgcccgtaaccaagctgatggaaaactccaacctccaaaaggcgaattggtggacaagagaacgggcaagattttagccgataagatccctgataaaaaagaaaagatcgctgaaataaccggtcttgatttcaaacgttttaccaaatccatccttctgtcacagggtgattttgccgcatttttaaatgcagatgataaagatcgggctgatttactggaagaactgacggggacagaaatttacggcattctgtctcaggaaatttatcaacgtcataaacaagcccaatctgaactgaatattcagcaggccaccgcttccagtatcgagttattaacaccggagcaaatagaaaattaccaaaacgaacagcaacaacttactgcagcagaaactcaactcagccaacagattaaggcttttcgatctgccgagcagtggcttatccggcaaaatgaattacaacaatcaatagcgggcaacacgttgcttttgcagcaggctgaacaggccatacaaaacgcgcaaccgcaattacaacagcttaccgccagcgaacccgcagaaaaaatccgttcactatgggatgcgcaaaaccgagcctttagtgaaaaacaacgaattactgaacaacgtataaaaatagaacatgatcgccagcaacaactttctttgttacagccagctcaacaacagcttaccgatttggaaaaaacacgggaagaacaccagcaacagcaaatccaacaggaaaagctcatctcagagcaggttataccactcgatcacaagattgatacgcaatcaaaagatctgcttacgttagaaaaggaaataaccaagcaagatcgtgaactgacagaaatctccgcccaataccaagtagcgcaaagtcgcaaagatacgctacataatgaacaaaaaacgctggaaacatacgacgatcagcacccttattgccgtagtttggacagcaaactccctgagtggaaacaattattttcacgtcagaaagagaagcaagtgcagatagccaaactgacacaaaaaacacagcagattggcactgaactggctcgtataaccgatcacttgaatacattgaatgcagagttggccgaacagacagagcaaaaccaaccactgcacgacaatctgatacttaccgaaaagcaactgattgatttgcagaaaattcatccactggaacaactgcaaaaacagctatcagactatcaggaacaactgaaatcacagaatcaacttgagatattattgcctcagatccagcaattacaggccacgatctcaactaatcaaactcaattatcacagtctcaggcattactggaacccttgccgactcagatcagtacgctagatcaacagctaacggaaaaacagcagcatcatgaagatcttgctgatcgaattcgtttggaacagcggatcaccagtctggaacaggagcgttcacagttaaaagaaggtgaagcctgcccactgtgtggcgccacacaacaccctttagtcaccgaataccagaacattgccctgtcacaatcagaagaacgcttaaaatctctacgccatcaaatagatcagctacaaacaaaccgttctgccctacagcagaaacagcagattcaacagaaaaataatcaacaattacagcaaaatacgactcaattaaccgagaaactgacaaaaataacacaacagtggaagcatcactgccaacagttacaatccgctgaattaccaatggaaacagaccctgtcgacaatttcattggccaacggcaaactgcctatcagcaatatcaaaggcaatacgacgcattattacacgcagagaaagtacatcaagcggcggaaaaagcgctatcggccaaccgtgaacagcacaaagcatctgaacaagctattgagctggaaaaggtcaaattagattcacaccaaaaacaactggcagaaaatacggcagaacttcaacaggcagaaactgaatacacaaccacgacagagctattagtcagcgaattacagcatacaccttttacccttccctctctgcaagaagtgacaatctggctgcaacaacgcgaaactgagttaaaaacctaccatgattcacgcgaaagatggcaacagttacagcaagaacaggctgccctgcaaagtcaatcgaatgaattagagaagcaaaaaactaagctgacgatcctccttcacgcccttaacgaaaaacagcagcagcaaaaacagttactggaacaaataactcaggaacgtcatcatttatttggggaaagatccgttagcaccgttcgtcagacattacagcaaaagactaatgagctggacatcgcgtacaaacaggctacttcacacctgcaacagcgacaaaacgtgatgaaccaactcactggtgcagttagtgaaattgaaagaaacagcaataccgccgaaacacaatgcaaacttaccgccagcgctttccaaagcggattggaacaacagggatttgccgatcaatctgcctttgaacaggccctactggaacctgaacaacgggaaaagctgcaacaattgcaagaacaacttacacagtatcatttgcaagccaaaacacggcaccatgaatcagaaaccgccttacagcgacatgctgaaacacagccccaattacttgaacaatatgaaccgacgcaagtatccgtgatattagctaacattagtgaagaattgaaacgtaacaatcaacagcaaggtgaagtcaaaaccatactgaacagtgatgctatgcgtcggcaaaaacaacaaacacttctgacacaaatttcccacttacaacaaaactatgatgattggagttacctcaataacctgattggttccgcagacggtgctaaattccgccggtttgctcaaggattaactctggatcatttagtccatctggcgaatattcgactggaaaaattacatgggcgctacgatttgcaacgcaaagatgatggagggctggaattgcaaatcgtcgatacctggcaagcagatgccgttcgggataccaaaaccctctctggtggcgaaagcttcctcgtcagcctggcactcgcactggcgctgtctgatctcgtgagtaacaaaacccagatagaatccctattccttgatgaaggctttggcacacttgatccggaaacccttgatatcgctctggatgcattggatcacttgaatgcgtcaggaaaaacaataggagtcatcagccatgttgaagcaatgaaagaacgcattcctgttcagatcaaagtggaaaaagtgaatggcttgggggtcagtagactggcatcagaatttcgggtttaaattataacacgttgatttaaaatataaatttattgatgcgtatggtgtgtatatgataaagcactataataatattctcctaaaatacaggtatagaggtgagtatcacctcatatgcctctcatcgatttaataaattggaataacaggaatgtctttaatcatcacatcaagcgattgctaataaaattgtttatcattcatttcactggcttttttaaccagatgatcaaaaactttatttgaatatagtggcgtattattaggggttataataaaaatacttaaaaaagccatcggactattataatcggcaatccatgtatctctgaccaattaaaattttccctgttgcatataatccaacatggctttccgctcctgattttgcagccccattttctactataaaaattaattttcacaaccatagcctgttaacacaggctatggttccttgatgaattcaatgctggataatatatattttttttgtcgaaatataccccatcgggttgacataaaacccaccaacataaggctttaccattttcgcattaatataataataaataggaatgaccggtgaatctgtggtaatgacatctaatccttgctgataatacaacttatcattagtctctcctgctttttttattaaagcatcgtaattattattttcatatagtgaagtatttttaacttgccctgacataaacatacttaaaaatgtcatagggctattataatcggcaatccatgctcttctgataacatcgaatttaccttgatgcatattatcaagcatcactttccattcttgattctgcaaaaccgcatcaacaccgaggttttttttccacatcgagctaaccgcaatggcaattttcttatgcgcttctgaggtgttataaattaagttaaatctgagcggattattctgattaaatccggcctcattcaataatgttttagctttttcaattcgccgagcctgagtccatgaagcataatcaggttctgtaaatttaaaccctccaacattgggaggaacaatcgtataagccggcttctgcccttgccccaatatcttcttaacaatcacctctctatctacagctaaattcagtgcctgcctcaccttcatattatcaaacggtggttttttattattaatttcgtaaaaataaacgcctgtttgaggagagatatagatttgatcgttcattgtattcttgagtgattcaaaagaatccaatggaatagtgttggtaatatcaatttctcctgccaaataacggtttagatctgctttatctgaagagagaggaagataagtcactttattaataaccgtatttttatcatcccaataatggggatttctgacaccgatgactttttcattaacgacccattctgacaatttaaatggcccgctaccgacaaaagattccggccttgtccatttattgccatattttttaatcactttttcattgagcggaaccataacaggatgggtcaatatctgtaaaaaatcccccatcggtttatctagactgacttctaaggtcacatcatccaatgcttttactccaagctcctcacctttcttcttgcctctgagcacatcatttgcatttacaatcgccgcattctcaagataactaccgtaaggagaaacaatatcgggatcaaccaggcgccgccaactaaacacgatatcattagcagtgattggtgcgccatctgaccatttaatatctttcctaagatggaaaacccatgttttattatcacgggtttcccaacgctctgccaatctcggctctatatgaccttttctgtcggtataaaccagcccatcaaaaaaatcatgaatgatattgaattcaacatcacttgaaactttgtgtacatctaatgaagcaggttctgccccattattacgcacaacctcctgcttagaggccaattttataccatcaagaacaaccgcagcatgggacaatgcaatatttcccaacatcatcgcaatagcacaagaaagtatttttatctttttgtttattgtgattttattcatatttcactctccatcatcgtatttatttttacatttaacttaaatccttcgtggaaaaatattcactctcatttaatgcttaatgatataaaggtcttttgtcgagacataacctcttggatcaatataaaccccacctagataaggctttaccatttttgcattgatataataataaacagtaataaccggcgagtcgttagtgaaaatatccatagcctgttgataataatcttttttattcgtctcccctgattttataaccagttcatctaaatctttattagaatattttgatgaattttgcgtactatctgacatgaaaatatttaaaaaactcatcgggctgttgtaatcgccaacccatccatatctggcaacatcaaacttcccttgatatttattatccaacataactttccattcttgattctgcaacactgcatcgacaccaagattctttttccacatagagctgaccgcaatggcaattttcttatgcgcttctgaggtgttataaagtaagttaaatctgagaggattattttgattaaatccggcttcattcagcaatgatttggctttttcaatccgctggttttgtgtccaggatgcataatcaggctgttggaaatcaaagccaccggttttcggtggaaggagtgtataagcaggtttttggccttgtcccaagactttattggcgataatgtccctatccacagccagactcagtgcctgcctgactctaacatcattgaaggggggcttttgtatattaaattcataataatagacgcccagccttggagaaatataaatttgttcacctgagtttttctttaatgatgcgaaggattccaatggaatagtcagagtgatatcaatttctcctgccaaataacggtttagatctgctttatctgaagagagaggaagataagtcactttattaataaccgtatttttatcatcccaataatggggatttctgacaccgatgactttttcattaacgacccattctgataatttaaatggcccgctaccgacaaaatactcaggttttgtccatttatcgccatattttttaattgctttttcactaacaatcaccataaccgggtgagccagcatctgtaaaaagtctcctactggccggtctaacttcacttccagcgtaaaatcatccagcgcttttatacccaaatcttccgcttgcttcttacctgtaagtatatcattcgcgttaactacagtggcattaaccagataactgccataaggagaacccatttgaggattaagcaggcgctgccagctaaataccacatcatgcgcggtaatgggtgaaccatcagaccatttagcgccttttcttaaatgaaaaatccaagtttgattatctttcgtctcccaacttgttgccagttttggtatgatgtcacctttattatccgtgtaaaccaaaccatcaaaaaaatcatgaataatattaaattcagtatcgctttctactttatgtacatccagagatgcgggttctgaaccattattacgcacaatttcctgtttatcagccagttgcgtacccggtgggacaaccgcagcatgggataaagtcatatttcccataataataacgatagaacaggataatgatttaattatttttttcgttattaactctattttattttttttcatattattctccataattatatttataatatattttatctaatgtttaattatatacaaatcttttgtggaaatataatccattggattaatgtaaatcccaccgacatacggttttaccaatttattactaacgtaatagtagataggaatgattggcatatcattggtgaaaatattcatagctttttgataatagattatatcattggtttcacctgctttaatcaccatctgatcaaaatcgctattttcatataagggtatgttatgactacttcctgtgatgaacgtatccaagaaagacatagggctattataatccgcagtccatgcgtatctgacaacatcaaacttattttgatgcatattatctaacatcaccttccattcttgattttgcaagttggcttgaacaccaagatgttttttccacattgaagtaacggctatagcaattttcttatgcgcttctcttgtattataaagcaggttaaattgcagtggattatcttgattaaagcccgcttcattcaataattctctagcttttttaatacgttgttcttgtgtccaagaggcagcttcaggtggtactaaattgaatccccccgtatttggcggaataatatcataggcaggtcgttgaccctgtcccaatactttatcagcaataacgtctctatctacggctaaacttaatgcctgcctcaccctgacatcatcaaatggcggctttttagtattgaagacgtaatagtaagtactcaacatgggagcaatatgaacctgatcgcccaattttttctttaatgacgcaaaggaatccaatgcaatagactgggtgatatcaatttcgcctgcgagatagcggtttaaatctgctttttctgatacaacagaaagataagttactttattgattacagtgttcttatcatcccagtactgagggtttctgacaccaaccacgttttcattcactttccattcagacagtttaaaagcgccactagaaacaaaaacgtctggctgcatccatttatcaccatattttttaacggctttttcactgataggcaccaaagtcgggtgagtcaacatctgcaataaataagcgacaggcttctctaatttgacttccaaggtaaaatcatccgtcgcttttacacccagctcttgttttttcttcttacctgacagtatgtcgtttgcattaaccacaaaagcggagccgaggtaactgctataaggagatcctatctctggatcaagtaagcgttgccagctaaaaaccacatcgtgagccgtaatcggtgaaccatcagaccatttgctgccttttctgatatggaagatccaagtctggttatccttcgtttcccagctttccgctaatctgggcacaatattgcctgtgctatcggtgtaaaccaaaccatcaaaaaaatcatggataatattcaactcaacattactttcaactttatgcacatccaaagaggcaggaaatgaaccattattacgcacaatttcctgtttatcggctaactgggttccgggcggaactactgctgcatgagattgcgcgatatttgccaatataatcgctatagagcaggtgagtattttggttgttttattttttataaacttagtcatgatatctttcatttttatcatctccattattgtcattattttttattacatcacattaccattttattgtaattacgacttaaattaatctattcatgtaataacagtctgtttaaccaggctcttattttcgataaaatctagtgtttaataatatacaaatcttttgttggaacatcccctaacgggctaatatgaaccccgccaacataaggttttactaatttagtgcgaacataataataaacaggaatggcaggtgaatcttgagtgaggatatcaagtgcccgctgataatatattttgtcgttggtttcatccgcctttaatacccattgatcaaattttttattactatattgcggtatattattggtatttcctgtggtaaaaatatctaaaaaagatgtcgggctattataatccgcattccatgcgtatttgacaacctcaaaatttccttgagacatggtatcgtacaatgatttgctttcttggttttgtaaaacaacttcaacaccgaggttctttttccacatcgaactggctgcaatggcaatttttttatgggtatctgacgtgttatacaacaaggtaaatttgagcgggttattttcattaaaaccggcttcattcagtaacgctttggcttttgcaacacgctgttcttgtgtccatgaggcataatcaggatgttttaaaaaaattcccccactaccgggataaactacatcgaaagcgggtttttgcccattccccaataccttgtcagtaataatagctctgtccaacgctaaagtcagtgcttgcctgacccgaacatcattaaatggcggtttttgcgtattaaaaagataataataaacgctcattatgggcgaaatatggaattgatcgccaaacttctttttgagtgttggaaagaaatccgatgggccaccgttggatatatcaagctctcctgccatataacgattgaggtcagctttatagtctgacagtggcagataggtgactttgttaatcaccgtatgcttatcatcccaatagtaaggatttctgacacccacaattttttcattcactatccactcagagagtttaaaaggcccgttgctgacaaaaaattcgggttgtgtccatttattcccatattttttgacaaccttttcactaatgggagacattaccggatgcgctatcatttgtaataaatccgcttttggccttcccaaagtgacttctatggttgcatcatccagtgctttcacaccgagttcttcgggttttttcttgcccgataacacatcatatgcattcaccacagttgcctgaaccaaatagctaccataaggagaaataatgtcaggcgtaaccattcgccgccaagagaaaaccacatcatgagcagtgatgggtgaaccatctgaccatttaataccttttcttaaatggaaaacccacgttttattatcgttggtttcccaacgttcagctaaagcaggaataattttatcttctttatcgatagccaccatccgttcaaaaaaatcacgcagaatatcaaattcactgctgctgtcggatttatgagggtctaaagagacgggttctgaaaaattattacgcgtgatttcttgtttatcggctaattgtgtaccagaaggaataatggctgcataagagtaagttacactccctagtataagactcacaatacaggttaatgctttagcaactttattttttattaagctcaccataaaattctgcatattgatattctccatagatattttgattattattaataaatattacatatatcactattaccttaatgatcatggctattacagttaatgccttcgtgtaattcacctgtttaatttacctaaactccgtcagagctgcttacacgtaacgtaaaaagcaacgccagataagtagcgttgctcttaattatcagaatcagcacgatacttacagtatctttgatttgcctgttttatctacagtaattttcgttatctcttactgaggtcacattattttctatttatatcaacgatacgatcctgttttggataaataatcggagactttttagcgaagtagttaacgatagcttctatatcagggacgctgtaaacagaatttgttccctctttaaatacagagaaattactgccccccgttgccagatattcattggccgccacgcgatatttcgcttttaagtctacaggcttaccattgattttcatcgaactgaacatgacacggttccccacgggttttgagctatcccatgcgtattcgaaactgtgagatatcgccagaacctgtggccgtgaacgatcccactgctgttccagcagacgtttgatctgctcgccagtcaatgtcttggtcaccagtatatttgaaaacggctgaacggtataaattgcgttgtacgtcacatcgccggcatccatcggggcgcggataccaccgctattcacaaacgcaagttgcgctccccccgccttttttggcgcggtggtgaataagtgagcgtcagcaatgactttacccaacgaggattcgccaccacgggttgtctgttgagtcagactgctttccagtttgccgatcacgctgtttgccagcggagtggcaattttttcataggcagacagcaagggacagagcttcaatgctcggctcgtcatgaaacatagaagatagcagcgggctggcgcctatcatgtcacccgcagcaaccacgatattattcggattctcttgcttcagttctttcagtagcgttgccatatgttcgataccccccggctgatttgcaccgggtgctttcagggcgccatgaaagtcattcaaggccagtacccgaacatcaactctatttgctgtgtcatcagcaggtttagttgcacatcccgccgccgtcaatgccagaacaataggcaatagtttaaaaaaacgcatagtgagaaatcctttatcaatgataacaatcagcctgccccacagggcaggttccagtcagatcagggtttatttcttctctgtcagatcaatttgatagacagcaaaaccaacatcatcatttttcaggtatttcacaggatattgagcgtgcgatttgatgaatattgcagctttctcggttggagacgtttcaaagcgcacatccagttttttatccgtcttgataggcaggaatgaccagttgttttcagcctgcgttgatactatgcccttctctttggtgattcgggaaatgtaggaggccagaatagtgcggttttcatcgggtgaagcgaaggcgatatggttatcacccgtacccgcaaatttaccgccgtaactacggtagttattggttgcaatcaagaaagtcgctttcggatcaataggtttaccctgataggtcacatctttgattcgattcgcctctttgttgagaagctggcagtcggtatcatatttcgcaggctgggtcagatctattttataatcaacgccgctgatggtatcgaagttataagtacggaagccattccagttcagtaaattttgcggtttggccgagttcggatcaatttggttatacatccccgctgaacattccagccattgaacgacgtcagcgccgctcgctttcactaccaccagggtattcggatagagatacaggtcggcagcgttacggaaagtctgatcccctttttctacttcgacaaaatcagccggcgcatttttgcgtccacccactttaaatggcgctgcggcagctaataccggcagatcggccagatcaggatctccctgaataaaacgcttggtgtaatcaatctgggcatcattgacgatctgaacggtcggatcgctctggatcagagccagatagctatacatatccgcagaggctttaccgataaatttgccaacgaacttacgggttccttcgtcctctttctcaataatggcagccagtttgttatcccgctcaacccgcgcttttttgtgggctttgtcgtaaattgggcgcgcttccgccttagctgattccgttttccattcgccgctgtcgttattgatcaccagatcaacaacgcccaagtgatctccccactgacccggcattacggcaggaatgccattgactgttccattggcaacatcgacgcccttgatgccagcatattcctgactcgggaagacaccgtgggaatgaccgaacatgatggcgttaataccggaaacttcactcaaatagtaaacggagttttccgccatcgctttgtaaggctcttgggaaaagccagaatgagggatggcgacaatcaagtctgccccttcttttttcatttgagggactaattttttcgcagtctcggtgatatcgttgaccaccactttgccatccagatttgctttatcccaaatagtgatttgaggtggcacaaagccgatatagccgatcttaatggtgtgttctttgccttcacgatctttgactggggtatcaacaataatataaggcgtaaagtagtttttgcctgtcttggcatccatgatattggcattaatataagggaatttggcacctgcgatggcctgtttcaggtaatccagaccaaagttgaactcgtggttaccaaagttacccacggtatagcccatggtattcatcagtttgtgggcaggatggacatcaccttttttaaggccttttgccgccatataatctgccagcggactgccttgaatcaggtcaccgttatcaaccagaaccgcgttggttgcttcagctttggctgctttgattaagttcgcggtacgaaccagaccaaattgctcagtaggtttatttttaaagtaatcgaaatcaatcagattgctgtggatatccgatgtttccataacacgtaaatcgactgttgcagcattcacattgaatgccaccagcattgccaatgttgaaatcttcaacacattcttcatcatgtaccccctctattgaatgatgtggaagagccggttaattggctcttcccataacattttgtctagaaatacaaacgtgctcctgtttccaaaatggtttgttttttatctttgtaaaccggattgtcactacgggcatcatcatatgccatttcaacaaacaggatcaggttattgtacttagaaacggcaaaacgtttatctacaccaaccgtataagtctgtttttataagttcggccaaattggatctgaccataatcccgatgagaaaaaccgagataaccgacacggttaaacatatcaaagctggtttcatagttatcactattggttttctgggtatcagaaccccatttcattttgccaaagactttaatagctttggtgagctcgtggctgcctgagataccaatacggctgccatcatcgagcattctgatatcacgatcctggctggttacctgcgcttttaaacggaactgcccattcagttccatctgagttcccttgtcattgtatacagtggcggaattaacactgccaaaaataactaataaacctattaaagctgctaacgatttcatatttttcataataagacactctcaaaatattaagtttaataatttgattttctttcgggtagaatgcctccctatcgcgagatagagtcgcaatatattagagataataaatccccgtcacgattttttcgtgaagatattcacaaaaacattttttatcaactgatgacaaataaaggaatttgttttactccatttttatgatcatccggaaacttaatatatttatctttatttacgacttaaagagttaatgaatttaaagtcaaataataaaattaacagtcaaataaatatcttttcattattataatgacatacgtcataagtaatttaaatgtattaattgacggaatcatccgtaacataaaaataaaatttaaatatataaatgatttttcaaaatgccagatcactttcttactcctcgcccccgaggagtaagaaagcttcaagtgcgaaatacatcactattatgaaaaggtatttttttgtgatttaggatgaatcttaagacaaaattaaagaggcagcactggaaggtgagtttcccgattatcctgatggaaaaatgcagtgggttgatgaaagagatatatgacctgatattgatagcgacatgtttaattcatgccgctacctgcgttgattaccggagtagatggttatttatgaggccacagccaagccgcacctcgtaccccactggagtcaccatgcagtgcttttttgatcggcgttgcacactccccaccaaaaacccactcttgaactaaatctggtaaggtctggtaaaggcgatcgacgttactcatgccacctcccagcacaatgacatcaggatcaagtaaattaataacttgtgccagcgcccgtgccagacgtctttcataacggcgtatagccaactcagctatctcatccccctgtaccagcgcttccatgatttcatgacctttcttacgaaccccgcttaagcggaagtaatccgtcatgaatcccgttcccgacacaaacatttcggtacatcccggtttaccacagaaacaacggacttcttcttgatatgcccgatcttcctcgtccatccacggtaacgggttatgtccccattcccctgccagaccatttccccccgcatgtaccttgccatcaaaagcaatacctgaaccacagcccgttccaataatgacggcaaacaccattggtttacctgctgcggctccatcagtcgcttccgacactgccagacagtttgcatcgttggcgacccgcacttcacgccccagcaaggcagaaagatccttatccaggatctgcccattcatccagactgagttggcatttttcacttttccggtaaaaggagaaatggctccggggatgccaatacccaccgttcccctctggccagtggtctgttcagcatcggcaatcagcccggcaatcgctaccagtgtttgctgataatcgttgcggggcgtatccacccgtttacgaaacaattcttcaccctgatcgcccaatgcgatcacttcaatcttggttccgccgagatcaatacctatacgcatagcttacctttttctatttctatcgttttctatcgttattcagagctgactaaattgtgttgctgcataatcattgcctgagccgcactgacaatcaagcgttatagccactctttatgctctgaaattgatgaagttctagggcttcgtcacatgattcgttattatgccccttacgttttaagatgttctttgtcacgatgcgcaaaaatatggggtagctgcatgttatggttcaaaaatttaatgatttaccgtttaaaccgagaaatatcactttctgcggatgaactggaagaacagttaagctcattggcgttcaccccatgcggtagtcaagatatgatgaagacaggctgggttcctccgatgggcgctcacggtgaaacgctcactcatgccacaggtaatcagatcctcatctgttcgcgcaaagaagaaaaaatgctgccttctccggtgataaaacaggaactacaggccaaaattgcccgtctggaaggtgagcagcaccgtaaactgaaaaaaacagagaaagactcactgaaagatgaagtgatccacactctgctgccaagggcattcagccgtttcaatcagacgtacatctggatagatacggtcaacaatctgattattgttgacgcagccagtgcaaagcgcgctgaagataatctggcattactgagaaaaacgctgggatcactgccagtcgttcccctcacattcaccgaccctattgaattgaccctaaccgagtgggttcgttcaggcgatttacccgccggttatgccttgatggatgaagctgagttaaaagccattctggaagaaggtggcgtgatccgctgtaaaaaacaggcattggtgtctgacgaaattgcgacacatattgaatctggcaaattcgtcactaaactggcattggattgggaagaacgtattcaattcatgctgtcagatgatggttctttcaaacgcatcaaattcagcgaaacactgcgtgatcaaaatgacgatatcgaccgtgaagatgttgctcaacgattcgacgcggattttatcttaatgacgggcgaattaagtgcgcttatcaaaaacactattgatgcgttgggcggtgaagcagaaaggtaattttttctgttttcccgtattcactgattatgtgaatacgggaagtaacaaaatgataatcatgcagccagatattaaatctggctgataaaatcagaatcgataaactaaaccaacccccagaacattatccgtattgatgttcacttttttggtaaagtcattgtctttcatcaaattgattttatattcagcataagtgcccatatttttgttaaaattatagtaagcaccgacagagacgtaattcactaaatcttcagagcttttagcagccagcacgttagtctcactgtctccacccaaatctttgcctttcgaataaacatagcctattgatggacgcagaccaaaatcaaactgatactgagcggtcagttcgatattttgtgttttatttgcgaacaaaacataattatcgagtttaccaaatcgggttaaattacggccttcaccatacatagcggccagatacacattgtttttgtcatattttacagacatcagccatgcttcagtattattccctttggcgacaaccttcgttttatcagtcccatttttttgtgcggaagttcggttagagttgccatatgatgcggccacactgataccattaccgaaatcataggagctggaaagaccaaaaccatccccattttgtctcaaaatatcatcacggccattaatggtgttgctgtcatttttagtctggtattgcagggcaaacttaagcccgtccaccaatccgaaaaagtcagtattacggtacgttaataaccctgtcgaacgccccatccagaaattatcggtcgcagctatggaatcacccccaaagaatggcaattcatccgtccatgcgttggtgtcatataccacaccatagttacgcccataatccagtgagccgtacttgccgaatttcaacccggcgaaagccagacgcgttctgttattcttagcaccttcggtttcagacccgcttgcacccatgttatattcccaacgcccgaaccccgtcaactgatccgtaatctgggtttctcctttgatccccagacgagcgacagaattatcaccatcctttttattccctgatttggcaaaataatgctgaacatcagccttgccatataaatcaattttattaccgtctttattataaatttcagcagcatttactgtgccagcgatgaggagaaccggaattgccattaccattgcgttgtgttttatcatcatcataatcctcattaatattgttatttatttagccactaccaataaatcaactttctaagaaatactttctctgaaagaaaccatttaggtgggcagagttttacacgcttctgttactctaaagttaaatttgtaacaagcgataacgatactaagatccaaaataacgatttgctaacaaaaattaacaaaaaatgccatcctgtgaaggaaatcacatagcaggtataaattcaatcagaaagtagcattaattatgatgataagttattaaaaacagtaagttataaataataaagaaagtaataaaaagtaagctccgtcattaatcaatctattttctcattgctaattacgatagatgccgtagtaagcgtctttgatatcattgacaactggctgtaagttctgtattcggtgaaatttgatttaagttcatttttatgcaaatgtgtaatgtttgtttttaataggatcacgccaataaagtacaaatattaacaatttataaggtgctaaaaatggaaaaaaaatatccacgcccacgaggtcgccctacaattcctgaacaagaaatacgccagaaaattcatgatgtcactctttctctcctttttacccaaggctatattacgaccacgatggatgtggttgcccaaaaagctggtattgcaaaaaaaacactctatcgctttgtcaaaaatcgagaagacttgcttgagcaaattgtactgcgctggacagatagctgtactcctacttttgagaaagatgccagcagttttaaacaggcaataaaattattagaaaaatatttgagagaaatagctcagaaattactgtctacagattctgtgggattattcaaattactgcaatctgatttcccttttcgggaagtgctactaaaaaaatatcaaaaaagtgtatttgaaagagacaaaataattttggccaattggctggagaaccaatatcaaaaagggttactgaggaaatttaactataatattatcagcgaattaatcctttcaatggttattgcagaaccactcagacaaatggttctgggtatcatcccacctctgccagaaacagatattacccctcaccttgcagcagcaataacgttgcttgaactgagtttggtaaagaaataacgcttttttacttattaatgtattcttatggcaataacgccattggcgctgaaatatcaatgctctcagcgctcatttcccagctaatctgcattttctgatagaacggaatcaagcagacaagcgggcttccagccatgataaccattgatcaatcccttctcctgtggacgcagacagtgcaatcacatcgatatcgggattaatacagcgggcggcttgaatacaggcctccaattcaatattgagataaggcaggagatcgaccttgttgatgatcatcaattcagcttcagcaaacatcatcggatattttaacggcttatcttctccttcagtgacagacaacataacaattttatgctgctcgccaagatcaaaactggctgggcaaactaaattcccgacattctcaataaataacaaactgtgttcggccggcttcaattgccggatagcttcacgaaccatttcggcatcaaggtaacattccttccctttattcacctggacggcctgaattcccacagctcgaatacggtcagcatcatggctcgtctgctgatcccccttaatagcagcacaggtaactttattccgtaatctattcagtgtggccatcagtagtgttgttttacctgagcctgggctagctatcagattcagcgccaaaatatggtggaggataaagtaccggcggttgcactctgcaatgtgattattctggcttaatacgtccagttcaatttgcagcatctgcttttggcaacggtcagacacaggcacatcaaattctggcatttgttcgttgccgtggtaatgatgatgcacatcaccattatggtgatagtagtggtggatgataataggctgattgctgttttgcggaatgtctgcatgaaattgtctgttttttttacctgccacagcggcataatccccattctgagaatcacttccctgctccggataagaatgagcaggttcgctcctttctccacaaccatatatgctcataactcagctcctactcaactttaatgaataccggtatcacgatactaaaactaaaacgtatctttgtttcccatcgaaaaaaatctgctgattctcagccagacatcaaacaccataaatacatccaatagagttgattgatacggagagatttttataaatcaccacatttataaaaaatcagatcaatgacaaacaaaaaacgtttcagtaataataaaaataagactagccgcaaattaacatgctgtctattcacattcatgataaataaaatgatttattcattatagaatcacatcaattacgttaagaaaaaataattaatcaacagcaaaaaaacaaaacataaagcattcaaataacacttaacattaatattatttgacataatcaaagtaaaataaacaaaataaaaccaacaatccttttaaattacaatttcaatattaacaacaagaaatcataactaaaattatttatatagtttcttattgttatattttacataattaatattaaattaaataaattacttttcctcttgccacccaataaccaccttccttcttccagtgcagtccattccgttgcctctccgtttcccaccatcaaaatcatcatcgccaataaaatgcccagattccccaatggggagttcacaaaaccacacttgatccgagcaattcacaagttcatcagtttgccgatagattaatttctgaagtcgccgacatcttccctgatccttatattcatattagtgatgatgaagtgagtgcctctcaatggcaggcttccggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcataaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccaggcttccgccaaaatacagacgttcatgcagaaaaaaggctgagaaatcctgttctcagccctgttcttaccgtccgatgaagaaatattttttatttcaacatcttttatttcaacatattgtattgcgatgccagattaccaaggaaatccagttggctgttgatcaggctggttaaatcctcctgattgatttggttgcccgataaatttcgtagttgattagcgaataaattccacgtttgttccagtttgaccgcttcagcgaggaaggttgtgcgctcttcatcgatttgtatcgtgtctgttatgccagcaagacgttgctctgtttcccgtaacgtggtcttcagcgtgtcagattctttggtcaactgatctatttgatcactgagtttaactctggcatcagccagctccgcatatttcagcccttcggagactttgcccagtatttttctggctatctccacaccttgtttaatcgcctgtttgatggcttcttttttaggctgggtgaaatccaatttatcgatgtcgctggcgctggggataaaatctttaaacatatccgcaatattattctggcggataacatcctgactttcgataattttagcccgagccgcatccagtttattttgttctgcggatttctgctcgatagcgctctgcaattccgttttttgtgattgagcttgcgtcagaagatctcccagccgctctgaaatcaccatattgcgaatgtcattaattttgccagtcagttgattcgtttcatcacggacattggaaataacctgatcgacatctttcgccaaatgctgaatcaattgctcgcgttcttccagcagagcattacgatcgtcatcattcagatcgggggctgccaaagcctcatcaatttcagtaatcgtttgaaaatattcttgcgtagccaattgttttagagttggttccaattgcgatagagaactgcgtacagcttcatcgaaatcacggcaataaagacttatccgcttggttttctcctcgataattgcaatacccgatgtttgtcgttgcgccagacgccagatattatttaccgcttgattcagggcttttatattgatttccggatacacggtttctttttttgagatgatattttcagacattttacagttccttgttattttataagcaattctgggaggagattagctattgagctttttatattctgccaaggcttcatcgaaagttttaactaattgcgcagcagaaccttgaacttctttccaaggactaatcacttgtttaaatgctgtcacgaaagaagtgagtttcagcgcatcattaatttcggcaaacttatccttagacgtattaatttgagtcagcatattgctccacataaaatccaagtgattcagagcaacttccgcatccagcatacggatatcaatgtcaccaaactgtaagaccaatttttgaatagacttttgtaatgcgcttttaccttcaacttgatcttgcaaaccgctgacttcatcaatcagtgcatttttccgtttacgggctttttccgctttgtcaccaaaaatgccgccggtaatagccagcccgataataccgcccggtgcaccagaaaatgacaaaccaacgaatttatcgtagtcttttttaagttgctcaatttcgttgtttttctcagtaattttctcattcaaatctttgatcgtggcagaaagattattatcttccatcagttttttcttattattgacctgtggctgcaacccatcagcattcttgccatttgataacgtaccaccaatcagtgtgcgcttaaaatcagataccgctgtttttacctgttgagtttttacctgttgactctcaatatctttcgccatgctattgaggatattccccaattcgactgatatctctttatcgtcattggtataagttatttcagccaattgcttctctgttaaatctcccagctttgtttttacacgttgaataatcggcatctcattaataatgctgattatatcttctcccgttccggtaatttgttttcccgcgctttccagattgatactctgctgctgaacattctcttccacgccgctccagctaagtgcatggttatgaatttctttaaacaaatcggtaatatctgcgggtttcaatccagcgatatcaatatcattgtaaccgatataacgctttacggtttccagagtaaaagggagtgacaaactgtgtttaacatataatttaatactaataaggtcttctttagtaaatattccaccaggacgggctgcaccgtcgatttggctcgccaataattttaaggtgatggcgggaagctctgctccatttatcgtactttctgctgaaaactgacttaatgacatatcgttctccattaatgatgattatttaaatgcaaattttcaatacattaagataaaaacaaagcacatcaatatccataacagttaagttagtattgtttcttcatgagttaccttaattgagaattaatatacccttgtatttttccatctggaaataattttatttcaatatgtaattaaatgagtatttaagttgccgttaatgagaaaaggcagtattttaatccaaaaatatatcttaatcagttagctatattttgtttatttttactaaataagtgcttcaatataaataaaactatatttatttatattttatttaactgaaattcttagattattttataataattaaacttctggaggttttataccatattataatgatggttataactcacatttttccatatagttaaagtggatataatataagtgaggagtaaataaatacctcgatataaggatatgggataatttttctaataaaaaataactcaagtctatatttagtattttcaacaagcctgtttttatataaagtctaattttattgggcaaatggtaatggttaagttattatttaatgattatttattataaatatatccaaaatagtttattttaaatattaatttaataaccaataaattctcataatataagagttatgatgacttaatcttaattctggataaaaaattaaactgcccgatatcactatccgggcagtttaatttcattttcagataaggcgctaatgaaacttattgagcggcaacggcttccattcctaccaagccaactttgagatagcccgctttacgcagggaatccatcacactcatcaaggtttcataatccaccgtcttatccgcctggaagaaaatcgtggtttctttattggactgagttgtctgatccaatactgaagatagattgtcacgctcaatcaattgttcaccgacatataactgatgatccgctttcacggtcagaaagacgggtttctctggtcgcggttgtggtttagctgacgatgccggtaaatctaccttaatatctactgttgccaagggtgctgccaccatgaaaataatcagcagcaccaacatcacatcaataaatggcgtgacgttaatctcatgcaattcaccgccatcgtccaaatcttcattaagacgtattgccataattgattaccttgcttctgctttttctactttgctgtcagccagatcaagatcacgacccagcaacagaattgcctgtgccgccatatcccctacttgaccacggtatgacgaaataacacgggcaaaaatgttatagataactaccgctgggattgctgccaccagacccagtgcggtcgccagcaatgcttctgcgatacccggagcaacaacggccaagttagtggtctgtgagtgagcgataccgatgaagctgttcataatcccccacactgtaccgaacaggccgacaaacggtgaaatagcaccaatagtcgccagatagccgttaccacgccccatgtggcggctgattgcagcaaccgcacgctccatgcggaatgaagtacgttctttggtgcctgctttgtcagtgcttgccgcagacagagcgcgttcagactgagcttcactcaacaacagacggctgatactttgcttaccgaaatctgaagcaattttcgctgccacatccagattggctgcatctgccaatgcccattgttccttgcgtaaacggcgacgagcaattaaaagttcagtacctttggagaaaaagagcgcccatgtaatgacagaagcgatcaccaaccccaacataacggtttttactaccgcatcagcattttgatacatgccccagacggaaagatccgttgcaaaaccactggatagactttcagattcgtccacaggttcggtagatttcgtttcagccgcgggttgagcatccgctttctgggcagcagccttcggttcacccgcttgctgtgcttcagtttttggaacatctacctgcagagcgccagaagatgctggtgctggtgttgccggagcggctacctgaacggctgcctgattttctggcgaagtagccgttgtgactggtactgtatcagcccatgctgaaccggttaatccgagtgccaatagaatagaagctgtcaaattacgcatcagttagccttactctctttcttatgaattctgttacttagcaataaattgcatttacgcatcttgctaatcctaatatgccctgaatcaggcttctcattacgagagggaaaagtccgacgcaaatgatatcagacattgagcgatttgatagtaattatcattactatttgacaaaaaagtgatcattaaaggaataattttatcaaagtgttcttctgttcccatttcagatcaccttgaattttcgtcaagttgttcgaatctctttgcacaaactgtcctaaatcttttaagttgctaaccattaattgaacaatcagcgaccggcagcgaagggaacttatatgaccgaaaagaaactggagaccttattggtcagtacaggcagaaagaaaaaatatactcagggtgctgtcaatcccctcattcaacgcacttcatccatcattttcgacaccgtcgaagacctgaaacatgcgttgaaaaaccgggctaagagtgagttattctatggacgccgtggcactctgactcatttcgcctttcaggaagcgatgacggagctagaaggcggtgcaggctgtgctctgtatccttccggcgcagcagcgatcacccattcgattctggcctttgtggcaactggcgatcatgttctgctgacagggagtgcttatgagccgacgcaagatttctgtaatcacatcctcaaaaagatgggcatttctaccgattattttgacccgatgatcggagaagggatcgcatcactgattaagccaaacacaaaagtcgtttttcttgaatcccccggctctctcaccatggaagtgcaggatattccgtccatcgtgcgtactatccgccagatcaatcctgagattgtcattatcatcgataatacatgggcggccggcattctctttaaagcgctggattttggcatcgatatttccatccaatcggccacaaaatatatcattggtcattcagacggcatgctggggacggcggtcgctaatgcacgctgctgggatcaactcagagaaagttcgtatctactgggtcaaattgccgatcccgatacagtttataccgcaacccgtggattacgtacgctggcaattcgcttaaaacatcatgaagagagcagcctgcacatcgccaaatggctcgcccagcggccagaagttgccgaagtttatcaccccgctttgccttcttgtccggggcatcattatttccagcgtgatttcaccggcgccagcgggttattttccttcctgctgaaggtcgaactgacccctcagcaattcgctgagtatctggataatttacatcatttcaaaatggcattttcatggggcggatttgaatccctgattctgggtattcagcctgacatgctcacttcgctgcgtcgatacgatcccctcaaaaagacgggaacattatttcgcgtgcatatcggattggaaaacccacaagacctgattgacgatcttgcagccggttttgcccgtattgcacccctttagccccaaaagaccgtactccagaaatctttacaaaaatcatggctgtctttctgttgcagatagccacggttgatttcctctctcttaaactgaatcaaactcgatgctgaatcaaatcaactccccttccgcgtttttccggtacactggttggcatgtatttttaatgactcgcagaaattacaggatagataatggaaatattaagcgagatcgtgcatgcgctctggcaacatgattttacccaactcgccaatcccgaggttatctggattatttatggtgtcctctttgtcactctggttctggaaaacggcttactgccagccgcttttttacccggcgataccctgctggtactttctggtgccctgattgccaaaggcgtcatgagcttcatccctacggttatattgctgaccatcgccgccagtctgggatgctggctgggttacttacaggggcgctggctcggccatactcgaattgtcaaaaactggcttgcccagcttcctgtccaatatcgcgagcgtgcccacgtgttgtttgctaaacatggtttgtccgctttacttgtcgggcgctttttggcctttgtccgcactctcctgccaacatttgccggtatttctggtctaaataataaacgttttcaattttttaattggttaagtggcttcttatgggtcatgattatcgtgagttttggctatatcttgaatcagatccccttcgtcaaagcacatcaggatctggtcatgaatattttgatgatcctgcctatcattctgttgttcagcgggcttttcgcttctctgttgatgtactggcgtcacaaaaagacatcatcaaaaaaaaagtaagtaagcatacttgtcgcttacctttatttaaaatattgtcgacatagcaaagtatttacctatttcactaacattattttggttgtcaatcgtcattaaactgataataaacaataccttgaatcacgttttatttatcccgaagtcgttatactcgatccaaaagtgacgtaacctaaaggagataaaaaatggatcagcagacaattattaagctcgttgatgggaatcttatgccacaattgggacttggcgtttggcaaacgagtaatgagcaagttgttaaagctattcacactgccctggaggttggctatcgttccattgatactgcggcgatttatcacaacgaaagcggagtcggcaaagcattaaaggaaatcgatattccgcgtgaagaaattttcgtcaccactaaactctggaatgatcgccaccaagatgccaaagcggcattagaagaaagtttggataagctgcaactggattacatcaatctctatttacttcactggcctgttccccatcaggatcaatatgttgaagcctggaaacagcttattgaactgaaagaatccggtctggctcgtagtattggtgtatgtaattttcacattgaacacttacagaacttgatgtcagaaacgagcgtcattcctgctatcaaccaaatcgaattgcaccctctgatgcagcaaagacaactgcattcgtggaatgcaactcaccatattacaactgaatcctggagcccattgtcacaaggcggaaaaggcgtctttgacaacccattggttcaacatctggccattaaatatgaaaaaactcctgcacaaatcgtgattcgctggcaccttgactgcggcatgattgtcattcctaaatctgtcacgccttctcgtattaaagagaactttgacgtatttgatttcaggttggaaaaagaagatttgacggctatggctgaattggatattggcaaacgaatagggccaaaccccgatatttatactggcgatcacgtcaaataatatcaatacggataagattcacttgaataaatatcccattgtttaatccatataaggcctgaactcgcaaaaatagagctcaggccatgcaaatgttcatccgcacctcacgaataaactgccgttcaaacaccaaaaatcattagataaatcgatattataaatagtaaccatgttgattatttatttatattatctggtctaggattattttattacttcaaataacattaatataagtaacatgcataaaaaatgcgtccttcatgatagtaacttatattaatattcacaacgttaaacttaaataatatttaaggcaaataataatgacttacatcatgatttctttattaatgctgatcccttttttctttttggtgaaacggttcctattatcaaatcatgttcatcagaatgtctctggcattatgttgacggtagttgcgatagctgttcatatgtatatatttcgctttgatagagttccgattgtcagcgtttccattcccaatattgtcgcttacggttctatcgtaattgcactgttacatggcatgatctattccatctgcttcagattgtattttggcagggaatcttatgatgaccattcaaggattgattaaaaaaaacggcttccctgctcgttgaataatcaactttggggaagccgttttttcagcaggatactgtcaaagctgacggtattttatcctgtgatttttgcgtgcatttcctgtacagaaatcacctgctcagtgggatctgcactgagtgccatggtagtcgcaaaaccaccattcagggtggtgtcataatgcactttatattgcagtgcgctacgacgcagcagttttgaatcttcaatggcctgacggcctgcggtggtattaacgatatagttatattcaccgtttttgattctatcctgaatatgcggacgcccttcatgaactttgttcaccagacgtgggttgatccccgcctcacccaacacaatcgctgtaccgtgggtcgcatccagttcaaagccctgtttgagcagtttagcggccaaatcaacaacgcgctctttatcttcttcacgtacagacaacagggcacggccgtgcttgcccatcgtggagctactgcccagcatcgctttggagaaggcttcagcgaaagtgcggccaacacccataacttcacctgtagaacgcatttccggtcccaaaatggggtcaacacccagaaatttattgaacggcagaaccacttcttttacagagtagtacggaggaataatttccttagtgacgccctgtttcagcagagattgacccgccatcacccgtgcagctacttttgccaacggcagaccggtcgctttggaaacaaaaggaacggtacgtgccgcacgcgggttcacttcaatcaggtacacttcgttatttttcactgcaaactgcacgttcatcagaccacggacacgcaattcaaaagccagtttttcaacttgctggcgcatcacgtcctgaatttcctgactcaacgtgtaagctggtagtgaacacgctgagtcgccggagtgaacccctgcctgttcgatatgctccatgataccgccaatcaagacacgctcaccatcacagatagcatcaacatcgacttcaaccgcatcatcaaggaagcgatccagcaatacgggagcgtcattggatacgctgactgcattctggaagtaacgacgcaggtcagtttcgtcatagacaatttccatcgcacgtccacccagcacgtaagatggacgaaccaccagcggatagccaagcccattacctttctcaaccgcctgttcgatggtggagacggtagcgttcgcaggttgtttcaaaccgagacgattgacagcctgctggaaacgttcacggtcttctgcacggtcaatagcatccgggctggtgccgataatcggcacaccggccgcttccaactcacgcgccagtttcaatggcgtctggccgccatactggacgatcacaccggttggcttttcaacacggacgatttccagcacgtcttccagtgtcacgggttcaaaatagagacggtcggaagtgtcgtaatccgttgaaacagtttctgggttacagttcaccatgatggtttcgtaaccgtcttcacgcagtgccagtgacgcatgtacacagcagtaatcaaattcaatgccttgcccgatacggttcgggccaccacccaataccatgatcttcggcttgtcatggttcgggttggattcacattcgtcttcatacgtggagtacatgtaagcggtatcggtcgaaaattctgccgcacaagtatcaacacgtttataaaccggatacaagttgtaatcgtgacgtaatttgcggatctctttgccagatacgccgaccagtttcgccaaatgtgcatccgcaaagcctttgcgcttaagatgacgcaggaaatcaaacgtcaggccattaatgccctgttcttccacctgctcttccaaacgcaccagttcttcaatctgtaccaagaaccagcgatcaatgttagtcaggttgaaaacgccatcaatagacatacccgcgcggaaagcatcggcgacataccagatgcgttcagcgccagcgcttttcaattcgctgcggatcttggtcagtgactgtggatcatccagattgactttaggatcgaacccggtcacgccgacctccagaccacgcagcgctttctgcatggattcctggaaagtacggccaatcgccatcacttcaccgacagacttcatctgagttgtcaggcggtcattgctgccagcaaatttttcaaagttgaaacgcgggatcttggtaacgacataatcgatagaaggctcgaaagatgccggtgtacggccacccgtgatgtcattcattaattcatcaagggtataacccactgccagttttgccgcaatttttgcgatcgggaagcccgtcgccttggaagccagcgcagatgaacgagatacgcgtgggttcatctcaatcacaatcaaacgaccatttttcgggttcactgaaaattgaacgttcgagccgccagtttctacaccaatctcacgcagtaccgccatcgaagcgttacgcatgatctggtattctttgtcagtcagtgtttgtgctggcgctacggtgatagagtcacccgtatggatacccattggatcgaaattttcaatcgaacagatgatgatacagttgtcatttttatcccgcaccacttccatttcatactctttccagccaatcaatgattcatcgatcaataattcgttggttggggaaagatccagaccgcgctcacagatttcttcaaattcttcacggttataagcaataccgccgccgcttccgcccatagtgaaagaaggacgaatgatacaagggaagccaacgtcttctgccactgccagcgcttcttccatcgtgtgggcgataccagaacgcgcagtatccagcccgatttttttcatcgctttgtcaaaacgctgacgatcttctgctttatcaatcgcgtcagcggttgcaccaatcatggtcacgctaaattctgtcagtacgccctgacgttccagttccagtgcacagttcagggcagtttgcccgcccatggttggcaaaattgcgtctggacgctctttttcaataattttgcgtaccacttcccaatggattggctcgatataggtcgcatccgccatttccggatcggtcatgatggttgcagggttggagttcaccagaatgacgcgatagccttcttcccgcaacgctttacaagcctgagcgccggaatagtcaaattcacaagcctgaccgataacaatcggacccgcacccaagatcaggatacttttaatatcagtacgttttgccatttttcttctgctcctgattacttggtgttctgaacgtggttctgacgatgctgttcaatcaattcaatgaaatggtcgaacagtgaagcggcttcatgtgggccaggacttgcttcaggatgcccctgaaaactgaatgcaggtttgtcagtgcgatggataccttgcagtgtgccgtcaaatagtgacttatgagtcacacgcagattcgttggtaaggtgctttcatcaacagcgaaaccgtgattttgtgctgtgatcatgacgacattgttctccaagtccttaacaggatggttgccgccgtgatgaccaaatttcattttcaccgtttttgcgccactggcgagcgccagtaactgatgccccaaacagataccaaatactgggatctcggtattcaagaaagcctgaattgcttcaatagcatagtcacaaggctctggatcgccggggccattagacaggaaaatgccatccggtgccattttcagcacttcatccgcgggggtttgggcaggaacaaccgttacgcgacagccacgatccaccaacatgcgtaggatgttacgtttgacaccaaaatcataagccacaatgtgatacggtaattcttgctctttgcaaacttccggtagcccatctgccaatgtccagcttccctgtaaccacgggtaagattgttcggtggtgacttctttcgccagatccatgcctttcaaaccagggaaagctttcgctttttccagagcaacttgagcatctgcctcattacccgcaatgatacagccgttctgagcacctttttcccgtaacaggcgggtcagcttgcgtgtatcaatatcagcaatggcaacaatgttgtggcgtttcaggtaatcagacagattttcttcactgcggaaattgctggtcactaaaggcaaatcgcgaatgaccagaccttgggcttggatggcgggggattcttcatcagcggcattgatgccggtattaccaatatggggataagtaagagtaacaatttggcgggaataggaagggtcggtaagtatttcttgatatccggttattgaggtattgaagaccacttctccaacagccacaccctctacacctatggcgcgaccatgaaattgggttccatcttcgagaaccaatatagctgacttaatcaaaacgccctccagaatgaataacaagtcgcatccgatgcatattaattcagaaataatcctttgaatcaatgccaattgatgatttttgtcaaaattttggcaaattgcgcgcattttaatgacgagagaggggattgtctacaaaaaatacctttttcattagcttttttacaaacctcagccctacattgagtgaatacacctgaaaagaacaaaaaagtaggttaaaacagtcgattaatatgaaataaaattttaaaacagaaaaacagtgtggcttttccatttcaatggaaaaaaagtaacaaaaagtcaaattatcactataaaaacgaataaaaattcaggctatcataataaaaaccaaataaatcgaaaaattacgtaattacacaaaaataattacgtaattacaattagttataaacacaaataattataaatttttaaggttaaggacatctttcatatcataaaggtcattgtttttcgcattcaaccatattgcagctttaatagctccattagcaaaggtcatacggcttgaagctttgtgacttatttctacacgctcaccaatgtccgcaaaaattgcggtatgctctccaacgatatcgcccgccctcaccgtcgcaaatccgatgcttttcgggtcacgctcaccagtatggccttcacgggcatagaccccacaggttttaagatcacgccctaaagcatgggcgatagattcccccattgccagcgctgttcctgacggagcatccactttgtgacgatgatgagcttcaatgatttcgatatctgtatactcccccatcactgtggctgctttttccagtagtttcagcaccagattaacaccgacactgaaattagcggcaaaaacgataggaatatcacgagaagcgtcttcaatcgcctgtttacctgcgtcatcaaaccctgtcgtgccgatgactattgccttgcgatactggcggcagattgcgaggtaagcgagtgtaccttctggtcgggtaaaatcgatcaggacatcaaaatgctcaataacatcatgcaaatcatcactgacggtaataccattcttgccgatacctgccaattctcccgcatctgttcccactaatgaagaacctgaacgctccagcgccgcaccgagcgtagcgccatccaactgctgggctgcctgaatgagatgacgccccatacggccacctgcacctacaacagcaacgcgaatatctgtatcagccataaagtcctcgctataaatcgtttttaattgaggtgataaagcaaattgtttaacagcttaactggcgaggactggcagcaccagcattagaggctaaccattagaaaaacagagatcaggaagagtgttataaaaaatgctaaacagcagccatatcatgataagccacaggttatacactctatagagtatgaaggtctaccatgaataaagtaagttgattatggtagaccctttaatattttgggaagaatattaattaaaataaatttaattaacttcttttacctcaactctcaattcttttggcacttcaaagacaatattctcttcacgtccatgcagttcggtgacgatatccgcaccaaaggctcttaaacgttcaataacctgctgaactaagatatccggagccgatgctcccgcagttacgccaatggcgtccacacctttgatccactctgatttgatatcatccgccgaatcaatcaaataagcaggtttacctacccgctgtgccagttcagccagacggtttgaatttgatgaatttttcgagccgaccaccaagaccacatcggcgcctgatgccaagtcacgaaccgcttcctgacggttagtcgtggcataacagatatcatctttgcgtgggccaacaatgttcggaaaacgtgcattcagcgcatcgatcacttctgatgtgtcgtccacagaaagcgtcgtctgggtcataaagcagaggttattttcatccttaacttgcagtttccacacatctgccggtgattccaccagatacatgccgccttcagggttattgtattgtcccatcgtgccttccacttcaggatggcctgcatgaccgatcagaatcgcttctttgcctttacgactcgcccgtgccacttccatatgcacttttgtcaccagtgggcaagtagcatcaaacagcatggttaaattacgggagcgggcttccgcacgaatagcctgagaaacaccatgtgctgagaagatcaggatcgcaccatcagggacttctgcaatgttttcaatgaaaatagcgccacgttccctgagattgtcaaccacataacgattgtgaaccacttcatgacgaacataaatcggtgcgccatacagttccaacgcacgttcaacgatgctgatggcacgatcaacaccagcacagaaaccacggggattagccagcaatatttgcatgattttcctccaactgagggtcaatctccaacacttcaatgtcaaaagtgatgttttggtcagccagcggatggttaaaatcaacgatgatggaaccttcagccacttctttgactaaacccggcatttcactgccattcatagcagtaaatagcatgatggttcctacttcaggaataccggcgtcggcaaaatcacggggtgtaaagtattgcaccaaatcagggttgggtttgccgaaaatggcttcacccgccagcgtgaattgatgtttatcacccacgttcaagccaagaagctgctgttccaatggcgcggagaggctgccatcacccaagcggaataatgcaggcttaccttgactgtaagtcgagtctgccgttgagccatcatccagctttaatgtgaagtgtaataaaactgcactgtgcacttgcacctgcgttgacatattgctcacacctattactcaaaaatgattacacgtatacccattaaaactgattgggtatagatgaaattatcagccccagtaccgttgaccggggctgatttcttattgtgatttcgatgctgttttcttgtcatccgggctgataaagctctctatgatgatgaaagccgccccgatacagatcgcagaatctgcaatattaaaagtgggccagtgccattccccgacgtaaaagtcgatgaaatcgacaacaaaaccatgtaccagccgatcgaacaaattccccaatgccccaccaatcactaaggcgtaagcagcattactcagtttctgcttggcactagagcggtacatcatcaccagcagtacagcagaaatgatgatagccaccaatgcaaagaaccagcgctgccagccgcccttatcagcgagaaaactgaacgcagcccccggattctgagcataagtcagattgaaataaggtatcaatggcgtggattcatatagtgtgaaattctgcaacactaactgtttgcttcctaaatccagtatcaataccactacaaccagccaaagccagcgaagaccagtggaacaaatgggtttattcatcaggcaaatttacgctcttcaccgttaccggcaacgttagtcacacagcggccgcaaagttctgcatgttccgccaccagccccacatttttagcatagtgccagcaacgtgggcatttttctccatccgctttgcggaaagcaattttcaagcctttaagttcactctgctgtgcatcgtcacccgctgtagtataagtggcaacttctacctgagaagtcagcaggacaaaacgcaattcgtcagaaagtttgttgagtttttctaccagcgattcgtcagcatagagggtaactgcggcttccagtgaactgcggatatgtttatcagcacgagcctgttccagaactttgttcacttcaccacgtacttccagcaattcagcccagaaagtatcgttcatatcttcgccatctgccagaccaaacagcccgtcataccactcttcagtaaagacatactgggcgcggttgcccggcagttcattccagacttcatcagcggtgaaggaaaggatcggcgctatccagcgaaccagtgcttctgcgatatggaacaaggcgctctggcagctacgacgcgccagaccgtcgctcttcgcggtatactgacggtctttaatgatatccagatagaatgaacccatttctacggagcagaactgcatcaaacgttgaacgacggaatggaaatcatattcgtcatagcatttgaggatgtcagcctgtgctgcctgagcacggcctaccgcccaacgatccagcgcgaccatatcttccgctttcaccatatgttgttccgggtcaaaaccattcaggtttgccagcaggaaacgagcggtgttacgaatacggcgatacgcatcagcagagcgtttcaggatttcgtcagaaaccgcaatttcaccagaatagtcagtggatgccacccacaggcgcagaatatctgcacccagtttgttcatcacatcttgcgggctgacggtattaccgatggatttggacattttgcgtccctgttcatccaccgtgaatccatgagtcagaacttggcggtaaggtgctttgcccttaatcgctgtagacagcattaatgaggacatgaaccagccgcggtgctgatcggagccttccagataaatatcggctgagttgccgtggaactctggacgagcgtcgacaacagaggagtgagtgcttcctgaatcaaaccaaacatccagcgtatccggtgccttgacgtaatcagcggcgtcagcgcccagtaattctgcggtatccagatcccaccatgcttgaataccaccaacttcaacacgcttggcaacttcttcgatcaactcttgtgtacgtggatgcagttcctgcgtttctttgtgcaggaacaaggacattggtacgccccatgtacgctgacgggagatacaccaatccggacggttttctaccattgactcaatacgtgcctgcccccagcccggtatccactcaacgcctttgatctctttcagggattgttcacgcagaccgttctgatccatgctgatgaaccactgtggagtagcacggaagatgatcggttttttgtgacgccagcagcaaggatagctgtgctgtaattttgccacattcagcagagcgcctttttcttgcagcagttcaacgataatatcgttcgccttgaagacaaatacgccatccagtgaaggataagtaccagagatatagcagccattcggcccgactgggttcgcaatttcaaggccatatttcaggctgatggagtagtcgtccgggccgtgaccacccgcagtatgtaccgcacctgtaccggcttcaagcgtaacgtgatcacccagaattgcaggaacgtcgaagcccatgaatgggtggttgaagcgcagcagttccagatccgcaccagtacagtcactcagcacttgccatgaagtcatgcccgcgcgctgcatgacggattcaaccagttctgccgccagaatcaggcactcgtcttctattttgaccaactgataggtgatttcggcattcagagaaatagcgcggttagctggtaatgtccacggtgtggttgtccagataaccagagaaaccggcaggccaggagactgtatatcaaatttggcatacaccgcgtccgcatcaacggccttgaagcgaacgtcaatggaaggcgaagttctgtcgtaatattcaacttcggcttctgcaagggaggagccacagtcagtacaccaatgaacaggtttaacacctttcagcaaatgaccattgccgatgatacgtcccagagcacgaataatatcggcttcggttttgaaatccatcgtcagataaggtttatcccagtcgcccagaacccccagacgcatgaaaccggctctttgtacttcgacctgactcattgcatatttgcggcactcagcacggaattcagcggcggaaaatttttcccccggcttgccaataatttgctcaaccttgagctcaatcggcaaaccgtggcagtcccaaccaggaatataaggcgaatcgtagcctgacagccctttggacttaataacaatatctttgagaattttattgactgagtgaccaatatgaatatcgccgtttgcatatggagggccatcatgcaaaataaatgtttttttaccagatttcgcttttctaatcgcctgatacaaaccttctttgtaccaacgttttaacatatctggttcgcgcttggctaaatccccgcgcatcgggaaccctgtttccggtaggttcagggtgtctttatagtcactcattatagattctcagttccaattttccgctagatacatgactcggatcgctgcaaaagacaatcccttgcagcaaccacatcatttgcgatttgctgtttaagcgcatcaagcgaagcaaatcgctgctcatcacgcaattttttgcgtaataccacatcaatatgacgcccatacagatccatctgggtatcaatcaaatgcacttcaagttgctggcccagacccgcaactgtgggtcgattaccaatattagcgacacccggtaagggtttatcgcccaatccataaacttccacagcataaacgccctttacaggggcaaccagacgtttcaacggtaagtttgccgtaggaaacccaatggtacgtcccaagcgcttaccgtgaacgactctgccacttatgctgtaaggatgccccaataatgtttctgccaatgccagatcatcatcttgcagcgcctgacgaatagcagtactgctgatccgcaggccgctgtcacagaagctgtctgtactggcgacatcaaaacagtattgtttacccgcttgttgtaaatagtgaaaatctccgagacgatttttgccaaaacggaaatcatcccctattgccagaaacttaacacccagtttttccacgagcaaccgtgaaacaaaggcttcaggtgaattagctgcgaaatttcggtcaaatttcacacataacagataatcaacgccatactgggatagatatcttattttatctctcagccgtgtcaggcgggctggcgctttatcgacagcaaaaacttccaatggctgcggttcgaaaatcatgaccatcgtcggtaacccggaacgcagcccttcttgtttcagatgtttcaataaagcctgatgcccgcgatggacaccatcaaaattaccaatcgtcagcacgcaaccatggtggcgcgcccggatattgtgtacaccgcgaattagctccatagctggctcaataccgtggaaattgccggattataccttgtacagcgcacaaggttaacccacgatcacaaagggtttttaattaataacctgattcttacaataaaaacaggccagatgcccgaaaaatatttaatttatctcacttctttagtgattcattgagttttttgttgcgaaaagctgtattccctttcagtaagctgataaaatcctgccccatcacaacgtaaacagcgtcgccgtacaacgacgtttatttgcacaaatccattgacaaacgaaggctgaacaggcatatttctcggcctttgaattgtcctcgctagaatatatttgggagttggaccttggctaatatcaaatcagctaagaaacgcgccgtacagtcagagaaacgccgtcagcataatgcgagccgtcgttctatggtgcgtacttttatcaagaaagtatacgtggctatcgcttctggcgataaagaagctgcacagaaagcattcaatgacatgcaaccaattgttgatcgtcactcctgcaaaggtctgatccacaaaaataaagcagcacgtcataaatctgctctggcagcgcaaatcaaagcaatgtaattattgtttttgattatgctgaaaaaccggcttagtgccggtttttttgtacctgtaattttaagtttcaatgtcttacgtctcaatatggttctcagtgttatttttttagtggtgtactgaataaagcagaaaaatccttgttacacacccgttgaacagccggatgttggatcatacgctccgcaaaaatgacataatattcttcttgtacagcatccaattgaccaatctcaacaatatcgctatcaacgaagatatcactggcatagaaagaaggcgcaataaaaatagcgttatgatacatgccaaatgctttcatcagcgcagcatcatcaaattcacccagcacttcaacttgcagatttttattacgtatccatgtcagaagttttctgcccagcatcgaacggcgaccggggatcagtaaacggcgctcttccagacattctggaaacggtttttctgggatcggctgacgacagtaaaagctgacattgcattcgcccagtttcactgagaacagcccttcttgctgagaagagtcaaccgggcaatctgacaggatcatatcgagcttatgctggctcagttgctcaagtagcatttcatgggttgattcaaaacagcgcagatggattttctcatgctctacaactgtggtttccagcactttgctgactaagcgcttggataacgcatctgctacacccacatcaaacaacaggtttgattctcggctgtaagtgacgatatccagcatttcgtgactgagcataaacattttatctgcataacgaaaaaccaattgccccaactcagacggaaccaaccctctcccctgacgcttgaacaactttccagccaaacgttcttccagagccttaatctgaccagtaatggtctgtggtgtcaggtataacgcctctgctgctccaacaacggagccttccttgcagacatgccaaaagtaataaaggtggttaaagtttaaatgtgaaacccgcatatatttctatcctaaattaatctattcatctgcgtttggcgatgttttctcttcggcaaaagtatattcaataatccataaccaataacagctgcggctgttgagccaatcaatatacccaagcgggagtaagtactgaaagcctcatttaaaccttcaaatgccagaccagaaataaaaatagacatagtaaaaccgatcccacacagtaccgagacggcaaaaatctgcctcagaccaatttcttccggtaatttggctatgcccagttttactgagatccagctaaacagaaaaatacccagaggcttgccaataaacaggccaagggcaattcccactggcaacattcccgttaagccgttcaatgttaccccctgcaacgaaacccccgcattggcaaaagcaaataatggcaggattaaataagccacccatggatgcaaaccatgctcaagtgcttcagaaggtgaatgaccttttttacagcgcaaagggatcatgaacccaacgatgacgccagctaatgttgcgtgaacacctgatttcagaatacaaatccacagaacagcaccgaccatcagataaacagatgttttagctattccgcgccagttcatccaaatcagaagcgctatcatagcccctgccaggccgagagcagttaacgaaacggttttggtgtaaaacagagcgataataatgatgacgcccaagtcatcaataatcgccagagcaagcaaaaagacttttaatgctgttggcacacgttttcccagcagtgccatgacaccaagcgcaaatgcaatatctgtagcggcggggatagcccaaccctgccgagcgatttcatcaccaccgttaaacaacaggtagaccagcgccggtgcgatcattcctccaactgcggcaatcgcagggaaaacggctttgtcacggccagccagcgaaccttccattaattctcgcttaacttccaagccgacaatcaggaaaaatacggccattaagccatcattgatccagagcaacagcggtttcttaatttccaaggcggcaaattgcaccgcaaccggaaggttgagaaattggtggtagataccctgcaatggtgtattcgccaaaaccagcgcaacaatcgcagcgataatgaggataattcctcccgctgcttctaactttaaaaactggcgaatgattgcagtcatgaattgataacctattaagttgattagggcactaatgttatgacagtcatgacatcggaaaaaatcgattatttatgcaatatgcatcgttatattcgaattataacattgagaaagtaacattttttcagagatgggtacattgctataagcatcaaaagctgtttttatcattaatccattaacgcggtgactaaaatatacgcatatgtcaaccttactattattatctgtactcgctgccgccttgttacatgctagttggaatgccttagtcaaaatcaatgcagatcgctttttgagtatttcaatactcgtattttttgccggtctgatttcgacatccggattgttctgggttggattacccacacccgcctctctatcgtggttaatactctcttccatcttgcatatcggttattgcctgtttctgagccgttcttatgccacaggagatttaagtcaggtatatcccatcgccagagggtgtgcaccgctaattaccgtcttattgagttggataatattgcaggaagtattaccgccctttgccatgctaggcgtcggtttaattatcgcaggggttattttgatcgcatttcctcacggtaagaaatccatccggatagatcgcaggacattaatcgcagcgctcacaacctcaatatttactgcctgctataccttatctgatggaattggctcccgtgccagtgatagcgccttaacctatatcttgtggttattcgctattcatggctggtcaatgggtgtgattatttatttcaaataccggaaaacggctggacaaaacgtccgtcaatactggaagcaagggttaataggtgggctaatgcagttgttgagctatggtattgtcatttgggtaatgagtcacgcctcaattgtactggtagccgcactgcgtgaaactagcgtgctgtttgcggtgctattatctgtctttatcctgagagaaccattcagcaaaatgcggttattagcctgtgtcgtgattgtggcaggaattttttgtactaagttagagtgagaagttcaagtaatataaatgaaaactcaatctgactacagaatgatatagccaaatcccttaaatcaggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtgacatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttacgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccttaaatcagattgagtgtcgctcaatatcttaaaaccataagcggctattgagaactattcgttgtcctttgacttgctcgtaaaagataaaatatttgtatgatccccccgataacggcaattccacctgcggcaacagctaggatccatattggaatactcaatgaaagtaacaatcctccgatagcggcaccaatagcactaccaagataaagtgcagactcattcaatgctaccgctaaatttccatctccctgcttctcacgggtactaatcaactcattattttgtggaacttgtaatgcccatcctacagctccccataatgcaattggcaacataaccaaccactgatttatttcagcgaacaatgggagtaataataatgaaatagcgagtaataccatgataatcaatgtcagtaatgggcctttaatccgatctataattggcccaatcaggaagctaccaataaccccgccaattccccatacccataaataagtggttacagaaacattcacgttataacttggctctgaaattaatggcgcaatgaatgtatacattcccaagctggatattgcagccaaaagggaaactgacaaaatcattaagacattaccatcagctaaaatagctatttttcttttcagaggaatgtgtgaagtatcgggcaaggcaggaagctttaaagccaatccaataaatgatgccaatcccaataaacttatcagccatagtgctgcctgccagcctgcataattagctaaaataaggctaaggggcacacctaataccactccacttgccatgccacccatgataatggcgatagatttaccctgattattgcgttctgaaagggctgccgaagctgcaattcccatagccagataaactccagcaccaatgcctgcaatagctctgaatattaataacatttgaaaattactgcttaatgcactggcaacattggccacaaagaaaatgacaagtgctaacaaaagcccttgcctctgcttattcatgggtagcactgcaacaattaatggagaacccagcccatacgccagtgtaaaagcagtcactaactgtgcagccatagcaacagatacggaaaaagatgtttcaatcaaagggatcaagccagccgttacgtatgaagccataccaagggcaaatgcaccaatggcaataagatatacggaaaaactactgtttgagtgcatattcaaacctcaacgaatttcattatgccaagagaaaccattgctgcttttaaaagtataagaatagcatgagtacctgctaaaaatttaactcaactttgtattcatttaaccaactattaagcccaaccgcaagttccattcccatacgggaatacataggtgaatttgaaccaacagaaaaactgagtttctcattaacaagtttttgatcaaaaagtgggcgaacaggtgcttgattatccaacatgatctcagacatggtgttacgcaaagcattttcataggcaggatcttgagtcgatggataaggacttttgacacgttcagaaattgatgctggtaaaatgtcacgggtagctgcccgcaatatacttttctcccgcccatcaaacgatttcatgttccaaggaatgttaaatgcatattcaactaaacgatggtcacaaaatggtactcttacttctaaaccaacagccatactcattcgatcttttcgatccagcaatgtctgcacaaaacgagagttatttttataatgatattttcattgactctattagctagttttttttgctttttccttttgaaagaaaggaaatataaataagaaaatcagcgagggtgacaatcaataattttgctattaatctaggggggtgggttatgttttcagaagataattctcttttattttttacatcacggttgattctccgtcaatttgaaataaaagatttctccaagtatcaaagttatcattcattgccagaagtttacacgtttctatatagttatcctccagcagatgagaatatgcatgcccaattcaatagagttatgtcccctgcatttaataataatggagatgaggtaaggcttgccgtaattctaagggaaaataatgatttggctggagaaataatgttaagactaacgaataaagagtcacaacaaggagaaatatacccgtcgtcattgaagatgcttgatttttcatttgtatcagatcatgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaattgcgtatatacgatttggaaaagactttacttgtttaataaaaaaattggtttagccaaacattcattaaatataaataaatagtttaaatcgatattaaattgaataatttattcgtattgttaatgaattattcaataatttgcctttatgcttacatttaaacaaacatgaaagtggaatttaaatttccgtcacaaaaaatcgttaagtttaacgataaatgctatagcaaactgagtattacctgactatagtaaatagtatcgaaggtttattttcatgctttgaaaaaaacaatgttaaagcgcacataaagcatctgagcatccacaaattaactcactgagatcatggaaacgatgaagaaccataaaatgcttctattgttgtgtaccacactgggatggtcacttatcactggctgctccagcataatgacccacagcgggccttatcaaggttattactctggagcaaaagccagcattggcatgctgaaagatgacagtactgggtgggtcatgaaaccgttacttgccgtagatctcccgttctctgcctttctggatacgctcctgttcccctatgattatacccgttccagcaaagaccaagctgaacactcacctaagcatcgccttgaaaaactggaacaacgctcaactgccacagcaacagctccagaaaatacgaacagtgaaacatagctattcccccacatcagtgatgccagtttcgacaaccaaaatttgccgataaccatcaatatcacgcatgaaagccacatatcggtcatccggtgatatcacaatcgcatccgcagaaggtgcatcatcagtacgtgctgtcagccgatgcatttcgccattttggctatcacagagcatgatactgttgtcacaaacaaaggcgatgaatcggccacgtctgtcccagttaaatgccgactgtatgtgatgtgtactgtgagtgatctgcactggcacgccaccatttggcgagatgtaccataactgaacgatacccgcttcgtctttcatcagaaagccgattttgctgccatccggtgatgttctcagccagtgtcggggaacatttaccactcccggccagcgattttgatgggtaaaagttaaacggcgctgtttcacacctgctggtggtgctggcagtgtggtttctgttcctgccaaaggctgtttgccctcaatggcataatcctcattattatccggtaaatcaacgagataaatttcgggtatcttttcaccgttctcagcacaggtatcaccaataaaagccagcgcccaacgctgccactgaccattttctttgggatatccccgctgcccaatccagccttcttcataagcccgattgatctcatcactgccagaacgtggctgcggtgttgtacggctgacaataactgaaaaataactaccatcatattctctgggatgttttttcggtggaatgactgctctcagaggaatagccacggcaacattgcgtaaatcaagcgcgggatctcgttcatgcatcacatggtcgttataagtaaaactcaaacggttaccatcagggctgaaaacgtgaacatgcgtaccaccgcgcagagcgccggatgtataaggtggagtaatatccagcgcctcaatgttgacggctacatttggctgggcatcagagacaatcacgcctcggcgatgatgaaaatcatactgccactgcgtatctggcttttctgggccgtggatgaacgcatagcgaacaggctcctgtggatttaccgtcacaacgccaacatgcgcgtcatcctgcgcctgataaatcacttttacctgcctactgccgacatgaattttttctatcgtgagacccgtaaaagacgcaccactggggcgaacgtcgtataccagccattgactatcaggagtccagatatttatattagttatctgatggctacggttgtcgaatgtaatctggcgttccttaaagaccatttttctaccttattttgcggagtttcgcataataaaaactaatcttatgtaaatatggctaaaaaatttcagtcgagacgttattatttcaacattacactttaactttacttctacattattccatttgatcaaacttatgctacttagtgttctttatatcattggtatcacggctgaagccatgacaggcgccttagccgcaggtcgccggaaaatggatgtgttcggcgttatcattattgcttccgtgacggccattggtggtggctccgtccgtgacattattctgggtcattacccacttggctgggtagaaaatccagcctacatcgtgactgttgcctgcgctgcggtgatcactatctgggttgcccccatgatgaaacatctgcgccgtttatttctcattctcgatgccattggtctgattgtcttttccattattggtgcacaaattgctctggatatgaaccacagcccgatcatcgccgccattgctgccgtgattacgggggtttttggcggggtactgcgcgatatgttttgtaatactatcccgctggtattccagaaagagatctatgcgggtgtttctttcgctgccgcttggctatatatcgggttattacacacgccattgcacccgaacagcgtggttctgattacgcttaccgcagggctggcggctcgattgattgctatccgttatcgtcttggtttacccatcttcaattatgagggttctgagcactgacattattaagagcatcggaggcatgttcttgctcccttgcttctgaataacttaccgactccacttctttcttctccccaaccgtattttcctcactttcctgtttttctccaattccatgtacagttaatgcatggactaacgttttaatctccggatgctgcaaaaaagctgcaatttttgcggtctgttttgtcgttaatgaattcttcgcgcctgttttggataacagtaaatcctgttgccagcccatttcatccgtaaatcgattggcataaggcaaccctatcgcttcacgccatgacgaaagcggctgtaatcttgcctgctggaactgagcaaaaatcaactcggcacgtttgatccctatgtttggcacttcagtaagttgtgcaatatccagcgccagccaatccgttaaatgtgtcaccagcccatgtttcaccaaagcggcccatgttccttgcccaatgccttgcatgttcagattttccccaagccatgtcagacgggcaataaattgttgctggcaactatcatgggatacaaggcaactcagcgaatgaaagtcctgcgcattcggtggctgaatatcaggccgttcagcaatacgccataccactttatcgagtttcggaacgccatgccccgccagcgctaccgtaactttatctcccggataaacgttccactgtctccagcgactgactgaaccaagattgacccgcctgacctgcctgtcatccagcttcactttttccagctccagcaaaacggaaatccttcctgtccggcctatcttgaaattgacatctctcacagttgtcaattgctgctgtaatgggtacttccaggcaatcgcccaactgtttgagcctgcacgccactgccggccagtaggctcagtttcctgtcttaagacaacgccatctgtggcaaaaggaagtggctggataaaataggagctccaccttttttcagcatcttccgcactgaaaattcggtggctatattgctgtgcagtgggaaaccccattgatgccaatcgctccagctttaccgccatctcatttggcccatctggccagccccagataaatattcctatctgaccaagttctggcgcagatgacttgcgcatcatcagccctgcgaccttgctgcgcgccccctgaccacctgcaacagattggcggtggttatcttgctgccagaacaactcaccttgtaacaccaagcgctctggtgcattttttatctgtttgggaatgtcggtaataaatgaacttttatccatccagttcgttccttccgaaccattgccacgactgattaaccccaccagtcggcctttttcataaaccaacgtgaccgcaacaccatccactttgggttgcagccaaacaaccgaccgtccctgtagccactggtgaatttcttttacccctttcagcttgtttaatccggtatgctgcacaggatgaggttgttttccttcccgtggcacagcaacagaaaacgtgctgtctgacgtctgatgcaaacaagttcgccaaagtgtcaggatttccaatagttgatcatagaattcgtcatcgatttcactgataccctgttgacgataaagctgatcccactccgccatctgccgtgtcaggtgctgcatttcacgttggattttctcctgtggccaaacaggacaatccgccatgtttcctgtactaccggtttctacgctttcagtaaattctgctggcacctgctctgccattcccgctaatgccacaggtattccaaacaacagcgccaatatcatgatgagaaaattaagcatccctgctccacacgtcccttaaacacgagcaaagaataaaaaacagtggaacttttaccaagcaggaaaagactaatttgcgaaacgcttcgaaaaatacataatcattttctgcaaccgtttatttttcctgaaattgtttcgcaaaatgattcattaatgtcagtgggttaagaaaaaattttgttgaaatgtccgttggcatgtattgtaacgctgcatgggttgacgtatccgtgtatactatgtgggattttatattcctgcgcttgcatttattaatacccaatcagtcaagaaatcatcatgaaccaaggaacgttatatattgtttctgcgccgagtggagcaggcaaatcaagccttattcaggctttattaaaaactcagcctttgtatgacactcaggtttctgtttcacatacaacgcgcccaacgcgtcctggcgaaaatcatggtgagcattattttttcgtcactgttgatgaattccagaatatgatcagccatgatgaatttttggaatatgctggtgtttttggtaactattacggcacatcccgcaaaattatcgaagatacgctagccagtggcgttgacgtttttcttgatattgactggcagggtgcgcagcaagttcggcagaaaatgccggcagcccgtagcatttttattcttccgccatcgaaggaagaattactccgtcgcctgcggggtcgcggtcaagacagcgatgaagtcattgacaaacgaatgtctcaggcggtcgcggagatggaacattacggcgaatatgattacgtcattatcaatgatgatttcaatacggcactggccgatttacaatccattattcgttcagagcgtatacgattagatcgtcaggctcaacggcatgatgccttaatcagcaaattattggcaggctgaaccaagtttcagtattatgcccagtcatttatttatctgtggagtagcacacatatggcacgcgtaactgttcaagacgcagtagaaaaaattggtaaccgttttgacctggtgttggtcgctgctcgccgagcacgccaattgcaatcaggcggtaaagatcctctcgtagcagaagaaaacgataagatgactgttatcgctctgcgtgaaatcgaacaaggcctcatcaacaataaaattcttgatgttcgtgatcgtcaggagcaacaagagcaagatgccgcagaaattaaagcggtttctgtcatcgctgaaggtcgtcgctaattttacggtaggtctgccttgtacctgtttgaaagcctgaatcagcttgttctcaaatatttgcctgaagatcagatagttctactgaaacaggcctatgttgttgcgcgggatgcccacgaagggcaaacccgctccagtggtgagccgtatattactcaccctgtcgctgtttcctgtattctggccgaaatgcgtcttgaccatgagacactcatggcggcacttctgcatgatgtgattgaagatacgccagcgacatttcaggatatcgaacagctattcggcacggctgtcgccgggttggtggaaggtgtctccaaactggataagctgaacttccgcaacaagaaggaagcacaagctgaaaacttccgcaaaatgatcatggcaatggtgcaggacatccgcgtcattctgatcaaactggcagaccgtacacacaatatgcgaacccttggctccctgcgccctgacaaacggcggcgcatcgccagggaaacgctggaaatctacagcccactagctcaccgtctgggtattcatcacctgaaaacggagctggaggagctgggatttgaagcactgcaccctaaccgttatcgtgtgattaaagaggttgttaaagctgctcgcggcaatcgcaaggagatgatccagaaaattctgtcggaaattgaaggcagattaacggacgctggcatccaatgcaccgttagtggacgggaaaaacacctctactctatttatcgcaagatgcacctgaaagaacagcgttttcactccatcatggatatttacgcctttcgcgtcatcgtcaacaatcttgatacctgctatcgcgtactggggcaaatgcacagcctgtataagcctcgtcctggcagagtgaaagattatattgccattcccaaagccaacggctatcaatccctgcatacctctcttatcggcccacacggcgtccctgtcgaagtccagatccgtaccgaagatatggatcagatggcagaaatgggggtggcggcacactgggcatataaagagcagggcgaatcaggcactacagctcaaatccgcgctcaacgctggatgcagagcctgttggaacttcagcaaagtgcaggaagctcttttgaatttattgaaagcgttaaatctgatttatttcccgatgagatttacgtttttacgccagaagggcggattgttgaattaccggcgggggcaagcccggttgacttcgcctatgccgttcataccgatatcggtcatgcctgcgttggagcacgtgttgatcgccagccttatccactgtcgcaaacacttagtagtgggcagaccgtcgaaattattacggcgccaggtgcgcgcccgaatgcagcatggctgaactttgtcgtcagttccaaagctcgcgccaaaattcgccagttattgaaaaatcttaaacgggatgattcggttggtctggggcgtcgtctgctcaaccatgcgcttggcaacggaaagaaaattaccgatattccgcaggaaagtatcaccaaagagctggtaagaatgaaacttgccacattggatgatttgctggctgaaattgggctgggtaatgctatgagtgtggttgttgcacggaatttactgggtgcaacggaaaagattccaaacaacaacaatagcacccgtaaactgcccatcaaaggggctgacggcattctgattacctttgcaaagtgctgtcgtccaattcctggcgacccgatcatttctcatatcagtccgggaaaaggtctggttattcaccacgaatcctgccgtaatatccgtggataccagaaagagccggaaaaattcatgcctgtcgaatgggataaagatgtcaacagcgattttatcgccgaaattaaagttgatatgtttaaccatcaaggcgcactggcgaatctgacggcggccatcaacgatgctaactccagcattcagagcatgaatacggaggaaaaagatggtcgcgtttattgtgctttcatcaggctgacgacccaagaccgcattcagttggcgaatattatgcgtaagatacgcgttatgccagatgtgatgcgagtcagccgtaaccgaaactaaaggttacttttcgaagaaggatatcccgcattggcggcagtttcacgccataagaggccggaacagccactgattgatcagcaggggcaaatcatcgcaagtgaatcatggtgggcagcaatgcaggcaacgactgcaccattaacagggaaataaatcacaccgacggagaaatcgcatgaaaggccgactacttgatgctatccccttaaccaccttgcgtggagttggagccagccaggtcactaagctcgccaaattagggctggtcaatctacaggacttgctgctacatctgcctctccgttatgaggatcaaacccgtctatattccatcaatgacttactgcccggtgtttatgccaccgtgacgggtgaggtcttgcgtacccatgtcacttttgggcgtcgtcgcatcatgacctgccaaatcagtgatggaaccggcgtattgaccctgcgctttttcaatttcaccgccgccatgaagaataatttagcagaagggaagcacgtcattgcctatggcgaaatccggcgcgggaatcagggacctgagattattcatcccgaatataaaacccagcaacacgctgaacgcattcagttgcaggacacattgactcccatctatcccacgacagagggagtgcgtcagacaacactgcgtaagttaatcgagcaagcgctggaacttcttgatacctgtgtcattaacgagttattgccggaagagtttagccgcaagcttatcagccttcctaacgcactgcatactttgcatcgtcccccgccggatgtttcgctgactgatttggataatagacgacaccctgctcaacgccggctgattctggaagagttgctggcgcaccatttaagtatgctggcagtcagggccggtgctcaacgctttcatgcccagcagctcaccgcagataattctttaaaacagcaacttattagccaattgccctttgttccgacaggtgcacaggtacgagtagtcgcagagatagagcaagatttggaaaaaaatgttccgatgatgcgcttgatacaaggggatgtcggttctggcaaaacactggtagccgcactggccgctttacgggcgctcgttcacggtaagcaggttgcattaatggcacccactgaactgcttgctgaacagcatgccaataccttccgtcaatggtttgaaccacttggcattcaagtgggttggctggcaggcaaacaaaagggcaaagcgcgtcaggcacagcaggaagctatcgcaaacggtcaagtaagtatggtggtcgggacacatgcgatgtttcaggagcaggtcagattctcaggtctggcactggttatcatcgatgaacaacaccggtttggtgttcaccagcgccttgcattatgggagaagggatgtgagcaaggctttcaccctcatcagttaatcatgaccgccacaccgattccacgtaccttggcaatgacggcttatgccgatctggatacttcgatcattgatgaactgccgccggggcgaacaccagtaacaactgttgccattccagatacccgcagaaatgaaattatccagcgcatcaaaagtgcctgtttggatgaaggacgtcaggcttattgggtatgtactctcatcgaggattctgaagttctggaagcgcaggccgctcaagccaccagcgaagaactggctctgatattgccagatctgaaaatcggtctggtgcacggaagaatgaaacccgcagaaaaacagaccattatggatgccttcaaacggggagagttacagttattggttgctaccacggtcattgaagtcggtgttgatgtacccaatgccagcctgatgatcatcgataaccctgaacggctggggctggctcaattgcaccagcttcgtggacgagtgggtcgaggagcagtggcttcacattgtgttctgctgtataaaaccccgctgaccaacaccgcgaaaatacgcctgcaagttctgcgcgacagtaacgatggttttgtgattgcccagaaagatttagaaatccgggggccgggtgaattgctcggcactcgtcagacaggcaatgctgaattcaggatcgccgatttactgcgggatcagggaatgctgtctgaagttcagcgcatctccagctatatccatcagcattatcctgaacatgccaaggcactgattgagcgctggctgcctgatcgctcacaatacagtcatgcctgatatcgatacccaaggcaccagcaagaccaaaatacccgcagcaatgtaagcaaaaaaatgccgctgaatatttcagcggcatttttagccaagttatctggcaagattaaaaacgaatcaaattaacctgctatagacgggaatatcggtaacaatagataaattttgataacggcagcgttaacaatatcaataaagaacgcacctaccattggcacaagaaggaatgccatatgtgatggcccacatcgatccgtaattgcctgcatgtttgcgatagccgtcggtgtcgctcccaaaccgaaaccacagtgaccagccgacaaaatagaagcatcgtaatttttgcccatcacgcgataagtcacgaaaatcgcatacaatgccatcactatcgattgcaccacgaggatcaccaacattggcaatgcaagtgaagccaactgccacagtttcagactcatcaacgccatagccaggaacaatgacaggctgacgttgcccagtaccgataccgctcggtcaaatacgcgataaaagccaagcagcgataggccattactcaggattaccccgacaaacaatacgcatacaaatgttggtaattcaaacatcgtatgctctagctgtttctcaatataactacctgccaacaaacagatagagattaaggcgatggtttccagcataaccaatggtgtaatcatgcggccggtataaggtttctcaaacgcagtaggaatttcggcatcatctacccccaagcccggcgctttggtatttttcaccagaaaacgagccacagggccaccaatcaaaccacccaatatcaaaccgaatgtcgcacaggccattgctacttcggtcgcattatcaaaaccatagcgttcggagaatactttaccccaagcggcgccggtgccgtgtccgcctgaaagtgtgatggaaccagccaataatcccattaatgggtcaagtccaagcattttcgccagtgcaatacccacggtgttctgcaccaacagcaacccaatcacgacaaagacaaaaagtaccagaaattttccacctgctttcaggctggcaaggttcgcattcaagcctatggtggcaaagaacatcaacatgaggggatctttgagagataaatcgaaactgatttcccaatctgtggactgcttaacggccagtaaaacgatagcgaccaatagcccgcctgcaaccggttcagggatggtatatttctcaaggaatggaattgattgtacgagttttcttcccagtagcaaaaccagcgtagccgcaacgagcgtgccataaatatccatctgatacatcgatgtaccccatctattgttaaagttatgtgaatttaatgcgacgttataatcatcctataaaaacgccaagagcagctaaggggtggattagaaaaaaaattactgataaacacaagttaaaaaatttaagaatgtgacgaaatcaaatcgttattcattataaaaatttagcgcaaacgattgccttaataaggcagatcattaaaatagtttttttttcccatccggaatttcacaccatggttacctcatcccgtgagcactctacatcagaagcacctgaggcatcaggcagcgaattgatttaccgtctagaagataaaccgccacttctacacgcactgtttgcagccagccaacatctgctggcgatgtttgttgccgttatcacacccgccatgttgatttgtcaggctctggggcttcctgaactggatacacaacgcattatcagcatgtctctgttcgcatcaggggtagcatcgcttatccagatccgctcctgggggcctgtcggctctggcttgctttccattcagggaaccagttttaattttgttgcgccactaatcatgggaggactggctcttaaaaatggaggagcagatatcccaaccatgatggccgctctgtttggtacgctgatgatggcggcaatcaccgaagtgctgctgtcccgcgtgttgcatctggccagaaaaatcattacgccgctggtttccggtattgtcgtgatgattatcggtctgtcgctaatccaagtcgggttgacttccatcggcggcggttactctgccattcaaaatggtacgtttggtgtgcctgaaaatctgctgctggcaggagccgttcttgccgttatcgtgctactgaatcgccagcgtaatccctacctgcgagtggcttctctggtcattgctatggcggtaggctatctgttggcttggtacatgggtatgctacctcatgcgacacccagaacagacacacccgttatcaccgttccctctccgttctattacggactgtcttttgactggaatctactgatcccccttatcctgatttttatggtgacgtcgttagaaaccatcggcgatattacagcgacatccgatgtttcagagcagccaatcagtggcccgttatatatgaaacgcattaagggaggtgtactggcaaatggtcttaattcgatagtttccgcagtattcaatacatttccgaattcctgttttggccagaacaatggtgtgatacaactgaccggcgttgccagccgccatgttggttacattatcgcgtctatgctgatcctgttggggctgttccccgccgtggccggatttgtacaacatattcctgaacccgtgttagggggcgccactattgtcatgttcgggactatcgccgcatccggtgtcagaattgtttcccgcgagccactgaaccgtcgcgccattatgatcatcgcgttgtcgctggccgttggtttaggcgtatcccaacaacccttgattttacagtttgcacctgagtggatgaaaaatctgctatcttccggcattgccgctggtgggctgactgcaattcttctgaacctgatttttccgcaggaaaaatagcggccagattttcattcctctgatttcccctcccgctttttcagtgggagttttttcatttttttgcataacccctcgcaatatcaacatgaatttcttcataaacacactgattgattgattatcaatctatctctattgtgtgaatatccgttttacggcataaaagagtctttatcagggggtcatgctgaggtgagatcatgaagtggttagggaaattttttgttactcttttgctgttgctgattctggcaattatcgtcatttatattgttgtccagacgcactggggaaccaaacaattaaaccaatggctcaacagacaaggccactatgagatcagcattgatagcatcagtcataactggctgcaacctgcgacactgacgctcaacaatgtgaatatccatgataagcaaagcgctttctcactcaatgtcagtaccgttaatctggatctcaaatggcaacacttgctgacaccgcgtaacctccaccgtctgacattgcaacaagggaaactgatactggcaggcgatcaattgccccccctcttgcaagcagacattctgcaactaaaccagatgaatattcagttagagaacccccacacacaaattaaaggggaaaatatcacgggtggcatcaccccttggatgcctgccgcaggaaacccgtttggcaatgggcagtatcaatttagtgccagtactatgagtttcaatggtattccctttgaaaaggttatcatgcagggcagctatcagaataagactctgactatcgacacttttggtgcagcatttctgcaaggggctatctctggggatggccggcaattatctgacggcagctggcgctggaataatctcctgatcagcaatatacgctggcaatcaccgatgacattgagcacgttgcaagaaaaaacccgtcatcttccggccattcatgttaaagacctcaatatcactaatgccaagctgcaagggaaaaattggtctgtcgattatctggataccaccatcaaaaacctgggactggtgaatggaagctgggaagctaaagatgggctgattgatttcaatgtcatgaatatggcattcaataacgctcagttcagcaacacgctggggcaactccatttttctggtgatacttttactgtcgctcatctgacgacccactaccaaaaaggattattcaatatccaatccgagtgggatcgcaaaaaccgtcaactgacgttcaataacagctcagtaaccgggctagtttatgacctgccacccacatggcggaacgatatcaaaaacgccgcaccgggatggatttcaggactgacattaaatgatatcagcgtcaataatactctgctgattgatgttaatccggatttcccatttcagctcaccactctctcaggccatgtggataccatgaatattctgaaaaatggcaggtggggattatgggagggtcaggcatctttgcaggcagccagcggaacatttaataaaattgaaataactcgtccctatctgcaattacacgcgacagatgacaggctaacgattgataaactgaacgctttcaacggtcatggattactacaagctagcggttcagctgaacagcaaactgcccaaaaaccttttgagcttaatttcaagggcatgaatgcggatttaggcatcctgccacgatggggttggataccacttactatgcagggagagggaaatttttccctcgccctgacaggtaatctctctgctgatgatattaaaggcaccatcaatggcacactgactgctgaagataaatcatcaaacaaagattcacaatccattgttcaggggctaattttaagcagtaactgctctccagctggaaccgtagatggcgctgcaatagcaccttcaacggaagctcataccgcagaggcaggtaatacccgcgcagaaagtgaaactgccgagagtaaaacctgcctcaaaattaaactgtaacagagcgttcgacaggcagcacaagataagtgccggtgaacacgctaccaacgccctgttcaccgctgacctgtacttccagtttaacccgtgccttgttgccacgggcaagacgagccaaatcgccgctcatgttattaaaatcagcgattgcactgggacgccccgtaatagactgtcggtagcggatattggcatcgaccagaatgatgttcccccccagctggcgttcctgtaacaacagccagatcagcccccatgctgtcagtgtggcctgtgaaaacaggctacccgcaaaaatggtatgatgcggattctgattccctgcttctggcatcgttgtaataaagcgttgccctgtatactgggtaatgcgtaagcccatcttttcgctcagagggatctgttgataccatgcctgctgcaactccgcacaccagtccggacgatgcagaatatcatcaagactcatgataggcttgatcatcaggaaatggttaatgggagacgttctggcaccattgatcaaaccccggtttttaaatcccagtttattaaaaaaatcaacggcatcttcccgtgcactgcaaacaatccgtttcacaccttcttgcctggcaactgattccaatgccatcgcgatcaatgtacccaaccctttctgctgcacattgggatgaacagccagaaaacgaatagcgccttcactgtctgcattgatatataaacgcccaacagcaaccggattaccgtgttcatccaccaccatttgatgatgagccatcgaatcgtaaccatctttttctgaaccgataggctgatgaagcggcttgcgcagcatctcccaacgaaattgataataggtttccagctcttgttctgtttgaggtactctcagatggtacataggaacaaccccttgtttatacgtgttgtcatgtgtagtcaggagagcgcatgcagcaaacgatgagtttttttcttgttataccagtcactctgttgaagtgagtctgcacatcatacctgcaaccaaaaagtcaccggcccatcatttatcagactcactttcatgtctgcggcaaattgccccgtttctgtttttacaccagttacacggcactgttcaacaaaatagcgataaaattcatctgctttttgcggttcagcaccgccagaaaaactcggccttaaacctttttgggtatctgcagccaaggtaaattgggaaacgaccagcaaactaccattagcctgctgcacattcagattcatttttccctgctcatcactgaatacccgataccccattactttttcacataaacgctgcgctttttgctggttatcttctttctcaacgccgagtaaaaccagcagtccctgctcaatttccccaatagtttcatcttcaacaacaaccttcgcctgtgttacgcgctgaattaatgcaatcattttttgtctgttatccatgtcatccttgcccaaaacgggcaaggaaagtgaggtaaaccgcctcggcaagggcagaagaagttacgtttctgagggaagggagaaatcatgtgccttaaagtaatcaggaatcacgctcctgtcagtcacatgaatagcattgatgcctatttttcttgcagcttcaacatttaccaaaacatcatcaaaaaatacagcctgtacagcggtcacaccttctgctccaagcacgtatttaaaaatgtcagaattcggtttgcgcatgcccagatcttgggataaataaaggaaatctgtagatgctgcaatctcagggtaatgatgtggccaataatcaaaatgcaggcggtttgtatttgacagtacaacaactcgatgtccctgttcacgcaatttattcatcagttcaataacatcctgtctgacatcaataaagagcgcatgccagccttctgtgaactgttcaaaactgagcgagacctccatttcatcgcacaacgcttctgcaaacgcagtatccgttatttgcccacattcatgttgctcaaaagcctctcccattgaaaatcgtgtggtcaatgttgccagtggtgttccactcaggttactccagacagccagtactcttttaaaatcaatatcaataatcacattacccatatcgaaaatatacagcataatccctcctgactgacgattgtcgttttgtacttttatcataattttgttaagaaaaaagagtgaaatgataaaaaaacagacaaattacgcttttgattaaaagttgttgaaaaaattaacaattttttgaatagaggtacaggcaggttaatagcgtggaggttaatcggaagaaacgccaataaaactcagagtgccgaagcaccctaagctattcatacgcaatttgcacacacaattaagcagcggtgaaattacatttctttgccgcgatttgcgcgacggcgatcattttcagtcaaatggcgtttacgcaggcgaatcgactgtggagtcacttcaaccagctcgtcatcatcgataaattccagcgcctgctccagtgttttcttgagatatggagacagtgtcgttgcttcatctgttcctgatgcacgaacgttggtcagtttcttacctgtcaggcagttcacagtcaggtcattggaacgagagtgaataccgataatctggccttcataaacttccgtaccgtgaccgaggaacagcttgccgcgatcctgcaaactatacagtgcgtaagcaaccgctttaccctgaccgttagaaatcatcacaccgttttgacggcgaccgatttcacccggacgaatatcatcataatgactgaatgtcgcatagagcagacccgtaccggaagtcatggtcatgaactctgtacggaagccgatcaaaccacggcttggaatagagtaatccagacgtacacgccccttgccatctggcagcatgtcacgcatttcgcccttacgctcacccagagcctgcatcacatcaccctgatgttgctcttcgatatccagtgttacctgctcgaatggttcctgcttacggccatcgatttcacggtaaataacttttggacgggaaacgcccatctcgaagccttcacgacgcatgttttcaatcaggacggacaggtgcagttcaccacgacctgcaacgcggaatgcatctggatcttcggtttcttcaacacgcagtgccacgttgtgtaccagttcttttctcagacgatcaaggatctggcgggaagtcacgtatttaccttcacgaccacagaaaggtgaggtgtttacgcagaagtacatgctgacagtaggttcatcaaccgccagtgctggcaaagcttcaacggcactggtatcacacagcgtatcagagatactcaactcgcccagaccggtaatcgcaataatgtcgcctgcttccgcctgagctgattcaatgcgatccaaacccagatgactgaagactttaccgactttaccgttacgggttttgccttcactgtcaatgatggtgatggtctggtttggttttacagtaccacgcttaatactgccaatgccgataaccccaacatagttgttgtagtccaactgcgagatttgcatctggaatgggccatccagatcaactttaggcggttcaacgtgatcaacaatcgcctgatacagcggggtcatgtcttccgccatgtctgtgtgttcattaccagcaatacccattagtgcagaagcatagacgatcgggaagtccagttgctcatcagttgcacccaagttgacgaacaggtcaaatacctgatcgacgacccagtcaggacgtgcgccaggacggtcaactttgttgataacaacgataggtttcaggccgtgggcaaaggctttctgggttacgaagcgagtttgtggcatcgggccatccatcgcatcaaccagcaacagcacactgtcaaccattgacatcacacgctctacttcaccaccaaagtcggcgtggcctggggtgtctacgatgttgatacggtaatcattccatttaatggcggtgttttttgcaagaatggtgatgccacgctctttttccagatcattggaatccattacacgctcagtcgttgctgcgcgttcgccaaatgtacccgactgctgcaagagtttatcaaccagcgtggttttgccatggtcgacgtgagcgatgatggcgatgtttcttaagttattaattgacaagtatttttaccattttaactatttgagaaaatattaaacggatacagcgtgcagaacgcaacgcgcattcatctaacacaaatatgctgttattttacacgttatatctacagagtgaaataaatgtgaagctcatcaccctagaagtttgtctgtacaggaagagataccatgatgagaggatgtaatcagtacatctagaacgtcaacaagatacagttctgcggtgggcttaatgatacctgctctgtttgacctttgcaccactagattttttctatcgtgataactaattaaaatcaactaaatcattaatttaaaatattattatttcagtcggtttttataagaaataacaatatttaaaataaggatagtaagaatatctttttgtggtttacagggttatttatatgtctttgcacgagttaatatcgatgtcatcaacaaaatataatttaatataatttcattttttacactgaacaaataggaaagaaattttcagattcagtagtgatagtttattttaattggccattaaatagatttatactactttcattattttaaagatctaatcacatttatctaaacacaaatatcaagagggataactcattattagcaaaagaaaataactatttgataattaatggttctgtcgcattaacgtgcattttggtttatggttgtgaaaactcaggatggaacccgacatactctcctatctgaaaaacgttcaaacgtttgcataatcccactgatattattgcccaatgcgtccggggtttctgaactatgcgcccagcctgcacgatcttgaagaaatcatggctgagcggagtattgtcattgatcattcaaccctttatcgctgggtcattaggttaatttctttgctgaataaggcgttacgccaacacaagcgcaccgtggagcggcggtagacgtcctcgatgcgggcaaggattgtcatcggcacaaccattctatctgctagcagcctaaaaaatcagccaaccgactttctgataactttcaacccgtaatgcaacgcaaccctatctatgctcctgagatctactctcttgccgccgcactgaaaatcgaaatttattggatataattctatcttgtataggttatttaattataatttaccccccttgtttccataggcaaattaataatacattcgaatttgtaggatcaattatgttaccatgtactgcatcataaatagaatatggagcatagggattattcggaggagcgttttcatctattattgcaaacttagcaaaatcctttttatctatatcatgaggtaattgtactctgtgaaataacccccatgaaaaagcatttctaaattcgtcagaaagagtttttggccctataacatcgcttaattttggtgttttaccccccatcttattatcactctcacagcttatattacttatcccaggaacataagggtcattcatttgatctattgcggtaaaaagtctaagtatattgaagttatatgcatataatctttcataaactacttcattatctcggtttaatgtttgtactagagctttgactgttgcttttcccacgttttcaaatgcaaaattgggatcgtgtttattattatacgaaagtataccatctggatcatcatactcataatcatgcacttttactaatttaccattttcgctattactaagaagtttattatcttttgttcttaattctccattatgtaaagtaccaactgcgttatatggcctttcttgctccttagtgaagagattaattgtgtcttttttaccctctctatacatgaaaagccccgccggttgtggtgaaacctcaaagtccaccaattttgcattctttgatacgtcaccgtgtggtgaagttatatttaaattaacctcaatatttttaataccaactaaactctttagctttattgttaagtaaccttcgctattagttgtaaattctgggtcaaataaaacgagatctttttcatctactaatttaggacttcttttgggttctcgactccaattcacttgcttaggatcaaatgaataattagatatctttttaccatttgttttattaataattttagctcggtattcatatgcactgtttccatcaccgggtaatgagtgctgactagtaaaattagtgacttcaatgctttcaatttcaaaatctattggtaggggtttaaaattaattgaatctatacgcaattaacttgaagatgcgggttttaaaatctggaagttatcagtcaaccgagtggtgagttctttcgctttttctggcaatgtgacatgaaaaaagtggcgcagcgtttcacggaatgttttggtatccggaaaatagacattgtttcgtacctgctcattcacatacttccataatcgctcaatcgggttgagattagggctgtaaggcggcaggtagtgcaactcaatattcaaaacctcggcaaaaaattggacgactccggaacggtgataacccgcaccatccagaataatgtggattttttgcgaaagtggataggtttcccggattgagccgaaaaaaaggacgacatttttcgcgttaatcgtcggatattcacgaacaatagtctcttcaatccgttgtaaattaagggcacccatgatgttgagtcgagtacgactgcctgtggtttcaaccactttgacgtgcttccgcccgctcttcatccagccataacttaattttgtggacagggtcgggtgaaccgcatcaataaataaaataggcgcattctggccacattcttctttcagcgcgttgtaggtttcaataaactgttgctgtttatccgcatcaaatttatgcggagcacccattggcttcttgtagctgaaaccttgacggtgaagccatttcgtcattcctgcgacagtgaaagtcacctgccatcgtgcccgaacataggccacaatttgtgcggtagtgtgcatcaaatttgccatcagatactcaactaattctgttgtttgttcggcagacaaacggctttcagagcccccattttcaggggcgagtttttcctcagagaagtaatctttcagatggcggctcaccgtactttcatggatccgcaaagcctgagcaatcatctgggcagtccagccttctgaggccaaaagcacggccttgatgcggtcacgtactcgtccatcgcgagtcgtatcatgcatcaattcgagggcgtctttttgggcatctgttagattaattttcatgggcgcaatcatgatctgatacaaatgaaaaatcaagcatcttcaatgacgacgggtatagcagagtcgctcccagtttgagataaaaaaagtatggcacaggttttgtcgccgtgccattgtctgggttttttccagagaattctcgtgcgtgtaattcattaaatatgggcagagcattttggtcaatattgcaatgaataatgaggtaaatgtacctcgtcctattcggacgaggttttattttgagtggattaataaggaataaataaaattatttttcagctatcaagtatattgattcataaggtttaattgacatctctttttctattgaagaaggcgatggataattacttattaatacctgccattctttatctgtgagagaaggttctggagaccatagctggttttcatcacttaaattcgcgataactaacatgacctgattctgccagcgacgcagataacaccaaagcgaaggatggtcgggtaacagatccagataatcaccgtaggtcagtatgggttgttgtttccgcaatttaattaattcgtggtagcaatagaagacagaatctttatcctgcaatgcagcttcggcattgagctctggataattatcgcaagaggctatccacggtgtgccagaggtaaagccggcgttggctgaaccatcccactgcatcggcgtccggctgttatcacgggatttctgcgccagaattgccagtatttcctctggtgccatgccttgctcaatgcgctcctgatacatattcaggctttcaatatcccgatactcttcaatacgctcaaagtgagggttcgtcatgcccagctcttcaccttgatagatatacggcgtaccttgcataccgtgcagcaccattgccagcattttggctgacgtcctgtgatgctggtgttcatccccaaatcgggaaacaatgcggggctgatcatgattgcaccagaaaagcgcgttccatgctttttgatgcataccttgctgccaggttgagaaaatctttttcaaggcaatatagtcaggtttggcgagagtccatttttcaccgttaggataatcgactttcaaatgatgaaaattaaacgtcatggacagcgcactgctatccaaagcgctgtaacggaggcagtgctcaagacctgtggaagacatctcacctacggtcatcaagcccttgggctggaacacatcacggctcatttcttgcagaaattcatgaatacgcgggccatcggtatagaaacggcggccatctccgtgatcgtcactcggataatcctgctgttttgagacgagattaaccacatccagccgcaagccatcaacaccacgatctgcccagaactcacagatttttttcagctcggcgcggacgggttcatgttcccagttcaaatcagcctgttttatcgcaaacagatggaggtaatattgctggctttcagcatgccattgccacgcattcccgccaaacttggatttccagttattgggcagggaatcgctggagccttcgcgccagatataaaactggcgcgaagggctattgatatcctgtgcagcctgaaaccacggatgttcggttgaagtgtggttaaagaccatatccaaaatgatgcggataccacggcgatgggcattttccactaaattgtcaaagtcttccattgagccataatcgggattaatggcacagtaatcggcaacatcatagccattatcaacttgcggagacggataaaacggcgtgatccagatagcctcaacaccgaggtgctgtagataatccagccgttgggtgatcccattgatatcacctgtaccgcttccggtgctgtcctgaaaactttttggataaatctggtagataacgctatctaaccaccaaggttgctgttcagtcataaagatatctctaaggaattaattcgttagctcattaattaatgtcgttttgcgctcgtttctgcgataggccagcacagtaagtagcataggcacgacaatggcgatgatcatggcaataaggtagaccatccagaactgcggcttgatagagagaataccagggagcccaccaacaccgatgccattggcaatcacatgattaaggccacataccagtccggccagacctgctccaatcatcgcgcagaacatcggataacggtatttcaggttgataccatacattgcgggttcagtaacgccgagataggctgaaatggctgccggaatcgaaacctcccgctctttctgcttcttgcttgcccagataatgccggcaacggcagagccttgggcgatattggataacgcaatgataggccagataggggttccgcccgtgctctggatcatttgcagatcgattgccaacgtggtttggtgtacgcccgtaataaccagtggtgcgtagaaaaagccgaacagggcagcaccgataggcgcgaaacttccggtcatcaggctcttgacgacccaagcgaccccatcaccgattgcgcgccccatcgggccgatcagcgtatgggcaaggaagaccgccagcagcagagaaacaacggggacaatcaccagatagagataatccggcacccattttttcagccgagtttcaatccatcccaacgttaaacccgccaatagtgaaggaataacttgtgcctgatagccgactttggaaatggtaaaccagccgaaatcccagacttccggtgcttgctgcccaagcaggtaagcattcatcaactgtggtgaaaccagcgtgatacccaaaacaatgcctaatattggggttccgcccatttttttaacggcagaccagcagatacctacagggaggtagagaaatatggcttcaccgattaaccagagaaaactatagatggtttgccagataggatatagctgggcgagtgttttgccttcactgaaagggatatccccaatgatgttacggaagcctaatattaacccgccgctgattaaggctggcagcagagggaaaaaaatctcagcaaaatgtgaaattgcattttcatgccatttcatattttgtcgggctgcttgtttaacctcttctttattaacggattgtttccccgtattttcaagcagggctttataataaatgtctacattggttccaataaccacctgaaattgcccggcattggtaaaacacccttttaccatggatagctcttcgatggccttggcattggcattttctggtgaatagagaacgaatctgagacgggtaatacaatggctgacagaagcaatattctcttttccaccaatcaaagtaataagtttttcaagatccttctgatttacttgatttttcttcatgcctttctccttagtatggcaggagtaataagtaactgagttttgctattaacagaatgattactctcgtgatgagataattcaaagactgaagtaatggctgatttatcctaatcagatttcaagtttttgaatatgaaaagatgttttgtttgagttttggatcacattttattctattggtttgaaactaaaaggctttttatatttattttattgattatttaatagagtctaatttccttagtaactaatggatataagatatgaattttgttggtttatgttttatttttaataaataaaggggttggataaaagaaaaaagacaataatttaactaaatagaggtaattttggggttttttgattagctgattcaggataacgacctttccattaatactttataagtaagtgatatggataagtgtattttcagtagtcatatttataatttcaacaaatattcacgctactactgacaataatgttgccacagcaatcaacggcatcacctgctccgggattaatcattttcttaaatatcaaatgttagcataaactcattttcagaatagcgcctttagggaatttcttcccagctatgacgaatttctgatattgttaaatatgacggaaggattggaggataatatcaatctttttcatattaatatttgccaaataggaatgaattatattaataagttaatttatattagaattataataataaaacataacattttaattacaactaaaactccttgattatccctatccagcagaaataatttatattacaggcattatcgttaaaggagtggatactccaccttaaactatatgcaaattttaatttgcgatttttttaagagtcatactagtttattttctgctattaaccgtttttgatgataaatagcaccctctgacatttggacacggacgtccatattttcgtccctttcccgtatagaatcgttaccatgttgtcggagaccgaaactgtaatccttttaataacaatcgtattttttgctcacagaacagtcatattttctttcaagatacttttttttgttgcaataaccatttatctagttcatttgcgaactgttggcgatcacgttggtttaacgtagcaggccctcccgtgtggatcccactcgcccgcatcgtatccataaaatcacgcatagtcaggcgttcacgtattgtcgcttcactataacgttcaccgcgcggattgagtgctattgcacctttttcgatcacttcagcagcaagaggaatatctgctgtaatcactaaatcaccgatttctgagcgacgaacaatttcattgtcagcgacatcaaacccagcagggacttgtaatgtacgtaaaaaagcggatgcaggtacacttaatcgttgatttgccacgaatgtaacctgtattttttcacgttctgctgcacgatataatacttcttttataaccttaggacatgcatcagcatctacccatatagacataacaggttcctctcaatttcatatttttagccacatcgggggctatttaatacaggttcatgaaggtagttaaagtaataagatgaactttactttaaaaaataatgaaaaacaattagataaaaatgttgaatcttatgaactgaattcgcacccaacataaattaaataaaagtgaccgtgatactcactcggtttctatgagttcaaactcttcaaagatcagttccatgttttcggaataagagttttctctctcgaaaaaattttgatgctctttcctcctgtacgaaagactcagatcgcctttgatttgctgctgtaatcggctgattaacaccgttaaatgtgttgcgagatcgcttcttagcttgctgtcatggtgtaaatcatagttataggacgcattgatatcgttgaggatctcatctacccattggtggctgttgggtgtatgcggggtgggattatcgtgttggggaattctctgtgcggcaatctcacctcaaaaaggtgggctaaacgaggataagggaacaaggccacggagatacctttagtttaccatttgatatccataatggtttcaattgcgccactgcgtaaaaagcgccgcttatccgacgtaacgtgaatcggtttattgactggcaggacacggatgcctgaacccagaaatatgggaatggtcgtaataaacagttgttgtaactccccagcatcggcaaaactggctgcggttttgcctcctccaatcatccacacgtttttacctttggcagcggctcttgcttcagcagcaatatcgttggtcgaggtatgagtgacaacggcactgatgcctggcggaatggatatatttcgtgaggagaggataaacgagggaatatcctgatacggccagtcaccggaggtatttttcatgatccactcataagtaccagcccccataatggctgccccaatgccttggtaaaattcatcataaggcgtggcgtcatcgccgagggtaaatgcctctaaccaacccagtccgtgatcttcggtagcgatataaccatccattgttgcggcgacataataaatgagctttgacatagttccggtttctccgcattaaataaactctttactctatcaggaagataaggaatggattagtctttttgagtgatcgcaatggaaaaacaggtcgaaatttacacgggataaataacgcatcatgataatatttagtgtgggttttgttatctgttatttagagggaatactaatgattacgcaatatcaaccgatgaaatacgctgatggagcaaaattctaaggatattttactggtaataaataataaaaatggttatttgttttttatgttagttttatcatgcattaaataatacccacgtaataatcaaaaataagatgtatcttactggacaggggtttgatttatcaataaaatatttttattatggcatggtattttttttcaagaacggatttcaacaaaatcaaaaggataattaattatgtctagatttattatcagtcggaacaacaagtctttacttaatgaaaccgtattctatcttacgaaagggaatatgcttacattaaagatagatggtttgaatagtaatacaaaaagacatcttaaatttcagtcgaataatacgcttgtgtccatttttcaacgtgataattatctgtttagagagcaaagcttgcaaataacagctcttaatatgggagtaagcgtggttagagcggtggatactgatatagattactgtccctattttgcagcaggtgtcgctgaggattgttttccaccattaacaattcatgtcttatccaaaatatcgattccaacggacttaactgccgagcagaaagcgattttaatggtgttgttagcggaaacgacaacgcctgagacaccgggaataaagtatgatgaaaaaaaagctaaagatgttatgcaatatatgcatgatgttctattgaacagagtccggtctcctaaagcacatgagcttgatgtgcccagtcaggggaataaattaatcggattaatttcaggagcacggacaatagaaggttttagtcaatatcccaatattaaatctgatataaaagatagaattaacggtatgataatagctgcgaacgaaggtagtaattcaaattttttagcttatcgacggttaattaaaaatgctattgatatagccaaaagtaataaaatctctaatacagagattattgcatggagaacgaaaagtactgattctcctggctcaaattttatcaagctattttcattacaaggacaagatttttataagctatctgatagttatcttaaataagagattatatatgaaatatttaattggtctatgtgttatttttttctctttaactgttttttctaagcaagatgaattggacttcaaggcttgggaaaagaagggcagttgggggatatatagtgaaaaaccaaatagtcattttaagccgctaaaaatcaagagctataaagagggttatttgcctgcattcagttatcttattaagcggtttaatttacaaaatgtgaataatcaatactgtctgattggttataagtggaataaaacaaaaaatagtgatgagcgtgaaaatattattgttttttggaaaacggctaattatctgattaattggaatttgccggatagtgaggacgatgatagttataaagccattatattcagcaaaccctttattgatatgagtgaatccgttgttccttataaggaatcagaaggtgcgcaggctttatgggctaaagaaggcgttattcaaatgatgaatgattgtgaattgaatgggcagaaaatcacgataacaccttctggggtcaggtaatatcacaactgctcgcagactgcgggcagttcgtgtttaaattagcggtaacaatatgcgcctattgaaatataaagagatttcgcggtttcgtataataaatgcaacatcgttacgctggaattaaacatatttgtgttccttgaaaagattatgactaatcttttgagctagttcggcttctaaatgagtatgccacgctcggcataaaatcggccaaaaatatctactgacatttttacatcaatttgactttgagtgttagcaccagaaggattatgaaaagttatttcttcgggtgtagcgttagtcaccagtacaagatgtccgccctttttttcaggtaatcgtgttggccatctgatactaggatgaacggaagctatatataaactatcttgggtaaaaacttcatgtatcttttcggccgtcataccggtcactatttgagagataatcccaaattgttccgataacattgaaactacaggagcataaatcattccttttatatgctcatcttctatctggtatgctccgtactcggttgccattttagttaatttcagcaatgggtaaattttccctgagcgagctgcaagcaacattttaagacaagccataccacaaatatgatttgcccattttgcatattcctctggggaatctgcaccggattgttcccatagcggatcatgactaagtggaagttgatggtgaataatgtcattggctaaatggaatgattcccactgagaaaaataggggactttcatagtctctccatgaacataagtaaaattgcgataacagcaacaaaggaaaataacatttgttcagagagttttccttcacgatagacaagcactgaaattagcataagtaaaggaattctgagagttattgctagatatccgtagctgacaggtaaataagtggcaatagcatagttaaaaaataattctggtaaaaaccagatgattgatatggaaagccaaaatttcagtggaacaaaagaaaatttatttttctgatagaaaaaaataacagatatattccctacgccagtaaataataaataggtaaaccaaccactcatgggaatccctgttcggtccataattgcaaacccgattacacagaatatcataatgaaaaacataagcttacttcgtttgtgcatgcttttaatatgaccaatcatagtgaaaagaattccggcgacaaaaagaatgttaatactgaggattgaggaaaaggtaagattagaaccaaatatcagtatatcaatgagtgcaataaacccaagagatatagggaatacataagtggcagatgaaaggcttttgttgataagattttgttgtgctatcagcattatgcctagaagcacccctttcatcaatccagcagatatccctgctaggttaaagaaatcagatggagttgagatgcccgtggttatggcgacaggaagtagagaaaggcacgttaaaaacgtgccagcgccaataataaaagcagtattctccggagatacacgttctgcaacttttttaagggcaagggttcgcaaagtcgttagtacggtgatcaacaaaaaaacaccatattgtgctatgttcaattgagataccttaacatagacgaagtattattattttccggtgttagagacaatgcggcttcaatgtgagcatcgatagaatcaattatttttattgaattttgatacaccctatcactgacaactaaaggaatttctgtacagccgagtatgacggcttctgcgcctaattcagctaattcatcaatagcacgatacattattccacgggatgtgtcagtgagtgcatagcgacatagatcctgataaatagaatcatgtatgatttgccgagtcctggatctaggtattaatacgtttattcctttagcttcaagtcgtttcttataaaaatcacgttccataacatattgagtaccaattaacccaacattggaaaccttcatgctgagtaatttatttgcggtggcatcaataatattgataattggaatattaaccagttttgaaagccgatcgcaagtattactggttgtattagaacaaataaggattttttttacttcggcttgcgcaagttgatgaactgctttgctgagaatgttaaattcagtctcattatcatctcgcttctgggcggcaagtatttttgaaaaattaaggctgataatagctagatcggcagattcaaaatctttgccagtattctgcacagccatattcaaacgtttataatattccatagttgatgcccaactgacaccgccaattaatcctattctttccatttttttacctttactcgataatgtagttaaaaatagattttttttcagaaatgttttgtgatgaacatgataggtgaataaacaagccaggtattgataatttgtgtccttttaacatcttagggaatatgctatttttcatcatgcccggaattggatttgattcaagaaagtatatttcttcagactcggtaacaataaagtcaaatcgacacataaattcatatccagtagattcaaaaattttaatagataaatcttttagtgttctcgttatctctgaatcttgtattaaaagaatttcttctgctttattaattcgatgcttttcatcatgaccgaaaaaaccattctttgtgattatttcgacaacattgagtgctattgctttcccttctattcgaatgcaaccaacagaatactcttttcctttgatgaaagcttgtaccaaggcaaatctatcgtattcaaaaatattttttaaattatccaatattgattttttttcattttccagattaacatatttatttgtaaataaagaagcgcctaatgaattaggttttataactattttttcttcagggaagttatcgctaatcaatgaaaatgctttttctagattaccttcagttaagagtaatgttttcggtgatcttaaagagggtaataaactattaatatagtgtgacatatggtatttactcatagatagcgaggaaggaagtacactaccaaatgttcctttaattttaaaatacttagcaactccttggatatgcccatcctcacctaaattaccatgaagaagattgatgtgaaattcgctttgtttagacatccttttgattgctgtatataaatctattttatctccagaatgagtaaaatcatagggagaaatataaggtgtataggcgttgtataagacagaaccatctttatcgaagaagtatattgaattaagatttctatcaaaattaagctctctgaaactttttataagattatcaaaagaactaactgatgctggatgttctggggaaattccaccaaaaatgatcgataatggtatagttgtttttgtatcgctaggaaaataaaccatatatatttcctttttttgatttttttaaaatataattcatgcattgaaatcaattcaagcatactattcatttcaatgcaataccttttggctatttatttttttaaaaaagaaaaaataaaaataattattaattgtttctataagtatttatagtggtgaatatttataagataatattttttatgtttaattaatttcatcctgattttataaaagatgtttttcagatcgacaacattaggctagcctaaataaacacagatgatcgtgttttggtaaacttattaaaacggctaattatctgattgattggtatctgccggatggtgaggacgatcatcgttataaagctataatattcagtaatccctttattgatatgagtaaatctgttattcatgataaagagactgaagatgctcaggctttatggactaaagaagtcgttattcaaatgataaatgattgtgaacttaatgggaaaaaaattacgataaccccctattttaagggggtcgtggctttataaattaccatttaattcatcgactactgattctgccaccaccgatataacccttcaatatctgctgaagtgagcatcttcatcgccgcttttaattgttccagcggccagttccaccactgcatttccagtaacatagcaatctgttcatctgaaaagcgttttctgatcaccttcgccggattgccaccaataatggtgtaaggttccacatccttggtgacaagagcgcgggtgccgataactgccccatcgccaatgtttacgccgggcataataatcgcttcggcacccatccagacgtcattgccgataacagtatctcccatcggttggtagccattttgagcatcagcaaaggccggttcttccgacatatagaaaaacggaaaggatgaaacccaatccaaacgatgtccttgattacctgccatcataaaggcgactccagtgccgatggagcagaagctgccgatgatcaacttatcaacatcaaccagatcgggatgcaggtaacgggcgcagtcatcaaaagagtgaccatgataataaccggaatagtaactgaaacggccgatctgaatattcggattagtgacttgttccgctaaggttttgcccttaaatgggctgtcaaagtagttttccatataacccttgctgttatctgattcgaatttgaaaattataattagtttttcggtataaagtcctgactgaatgtcagccgttttcgtccctgttccatttctgccagcggctccacttcccgtaaggtctttttgcaacgtgtgacgagatcctgagatggtaacaattcattgtagctccaatatagccatatcatttttctcccatttggtttttggcgtcattttggcacgtatattgatttttgttaaagaaaatgttaaattagaccgtatattaaaccaataaccgcaatacggtggagttttgactatggccacattatcaaatgaaagaatcaccactagggtgaattcagaaactaaagagttgcttgaaatggcactatcattatctgggtatgcgagtttgaatagttttattgcaaatgctgctgtagcagaggcgaaacgactgattgaacaaaacatgcgcatcaaattgtgtcaggaggatgcagtggcatttgtgcatgcattagaagaacctacccagataaatgagcgtttccttcgtgcagctcgtagacataaggatttgttagatgaagatcgagtgtctaaataaaaataaacacgatagaaataattttgactgtggtgaacctgcgttaaacaactatttgaaagcagtatcagggcagcatgataaaaaggacctatcaaggacatttgtcctgacaagtagtcagaatgaatctcaaataaaggggtattattcactagcgctgtgcacggtagaactagacgaaataccagaaaaaatatcgaaaaaatacccttccagtttgtattgcgcacttattggccgattagctataaataaattatttcaacgccaaggacttggcgaaattttgttgatagatgcaattcgaaaatcaatagaatcgtcagaatccattcctactccaatgattatcgttgacgctaagcacgatattgctaaaaaattctatataaacatggggtttcaggaatttccaaaaatgaaattcaggctctttatgcctatgaatgcagctgtgaacattatagagcaaatcgacgcgatataattcaacaggtgggaccgcggtcccacctcattcttcagtaatttcacctacaccagaacaatttgtgcattgctgcacctgagttgcatctgtgtggtgttctgctcaagaaaaatcggacacttttacgaaggccatttcatattccacgggtgttaaatcattattggccgtgtgcaatcgtgttaaattgtaataatgcagataacccaagacatcttttttcatctctgcctggttttcatgatgggttttggtttcagctgcctgtgggactgtatagctctgttcaacaaccagattgaccgcttctcttttaaagttatcggtaaatttttggggtgattttcgtttcataaagacaccttaattaaagtcattctattcctttaccaaagtgtccgaatttattaaagcacaacactgattaagacagcggccgggtggacaaaaatgctaaccaccaaaacggcggtaatacgcggccgcaggtggcggaagtgtgccaatggtggtttcacagcgttcgctgacgtaatgtgtcgcagtaaggtctattcggtgatagatattggtgcacaagttacgggcaacctgcccttcccattgtgctggcagcaaagcatccggcagcagcggatcgcgcagtaccacacggcggtaaaagtgaataagcagcaggcgcaactggaagctgcgttctggtgtcaggtcggcttcactgcaatcttgcagcagcttcattaagggacggaatgagacgataaactcgtgatagtgttttaccacctgatccagtgaccaactggccgatacccgttctttcaggctttgttctgaacggggatagggatagtctgcccgaaagtagatcacagaatcactggcgttgagttcgccaagcagggcgggaatatcactttgcgcgctgcttggcgccgccatcagagtgctgttgagttggccgaagccaagccagctcagttcttttttcaggcggttgcgttcttctttggtcgtgccttccagcagcagtagatcccacttgccatcccactcaggctgttcgctcaggtagattttgctctcggcatggcggaattgattcatgccacgctcggtgatgcggtaatagctgcgacggccgattttctccaccgccagccagccctctttttgcaggcgaaagacggatgtccgcacaaaacggtcactgaaccccatcggttccagcaggaggctcagactgcccaaccatacttcaccaccacggtgactgagggcatccccaaacagagagataatcagcgacgttccgctgatgggctgggcatcaagggcgtgtcggataaagtcgtcgagtttgtgtgccattttttccattatctgctcgcaaatgtgtcatgccattagcataaccggagaaatataccctgcaacttgaaatagtctcagcggtggcgaatgattactcatgctggcggtggtcgatcactctgaccgccttgccttctgagcgggggatgtctccgcagttgacgatactgacttctgtactcagccctatcatggatttaatgtgatggcgcaactggtggcagatgtcgcagcgttgttgagcatcaagccgctccggttcttttagctcgaccttgactgacaggcagtcataattgcctgtgcggttcacttctaactgataatgaggcgacagctctttgaagcggatgatctgttcttctacctgtgatgggaagacattgatgccacggataatcagcatgtcgtcagagcgtccggcgatcctgtccatacgacgcatatgacgggcagtacccggcaataaacgggtcagatcgcgggtgcggtaacggatcacgggcatggcctctttggtcagagtcgtgaaaaccaattcgccggattcgccatccggcaacacgttcaggttgtcaggctcaatcacttccggatagaaatgatcttcccaaatggtggaaccgttagcgtgttccaccgattccatcgcgatccccggccccatgacttcggacaggccgtaaatatccaaagctttgatgcccatgcgcgtttcaatttcgctgcgcagcgcttctgtccaaggctccgcgccgaaaatgccaacacgcagggagcatttactggcatctccgcccatccgctgttccagcgcgtccagtaaagtcaggcagtaggaaggggtcatcatgatgacgtcgggtttgaagtccagaatcagttgcgcctgtttttcggtctgaccgccggacatagggatcacggtggcgcccagacgttcagccccgtagtgtgctcccaaccctccggtaaacaggccgtagccataggcgacgtgaactttgtctttggcgctcgctccggcaaagcgtaggcaacgggcgaccagattcgcccaatggtcgatatcccgctgggtataacccaccacggtaggatgccctgtggtgcccgatgaggcatggatgcgcacgatttgttccatcggaacggcgaaagtatcgaacgggtagtgatcccgtagatcctgtttggtggtgtagggaaatttggtgatgtccgcaagttgcctgaaatcactgggatggatgccggcggtgtcaaatttgcggcggtacatgggcacgttgttgtaagcgtgatggagcgtccattttatctgttcaaactggtgcgcctgaatttcgtcacgtgaagcaaattcaatggaatcgaggtgttgtacgttgttgctcatagtttcctgtccctttgttgatttgtttgtaacaggttgttgtttttatgtgcaggtgtgggttatttgctaatacccgatataaggcgttgccgttacgatatgcgttcaataatcatggcgatcccttgccctacgccgatgcacatcgtgcacaaggcatagcggccggtacgccgttccagttccagagtggccgtcagcgccagacgtgccccgctcatgcccaatggatgacccaatgcaatcgcaccaccattcggattgacctgttctgcatcatccggtagccccaactgacgcatgacggccagtgactgtgcggcaaaagcttcattgagttcaatgacgtccatctggttcaggctcaggccagtgagctccagtaccttgcgggtggctggcaatggcccgatccccatcatgcggggttcaacgccgcaggtggcggttgcgataatgcgcgcccggggtgtcagcccctgctgcaaggcggccgtctctgaggcgatgatgagtgccgccgcgccatcattgacgccagaggcgttgccggcggtgattgttccatcaacccggaagggggttttcagccgttgcagttgttcgaatgtcgtctccggccgtgggtgttcatcccgtgagacgatggttggtgtgccttttttgtctgtagagggcagggtaatgggggtgatttcttccgcgaaaattccccgttgttcggcgttggcggtacgttgctggctgcgcagggcgaaggcatcttgatcgtcacggctgatttgaaactgggcggcaacattttccgcagtttctggcatggagtctgtcccaaactgctgctgcatcaggggattgataaagcgccagccaagggtggtatcaaagatttgggcttggcggctgaatgggctgtcggttttacccatgacgaaaggggcacgggtcatggattcgaccccgcccgccagcatcagttgcgcttcgccggctttaataccacgggcggcaaaggccaaggcatccagaccggagccgcacagccgattgagggtggtcgccgataccgaatagggtaaccctgccagtaaaaccgccatgcgtgccacgttgcggttatcttctcccgcctgatttgcgcagcccagaatgacgtcatcaatctgttgccaatccagcgagggataacgtgccagtagtgcctgtagcggcagagcggccagatcgtcagcccgcaggccggaaagcgcaccaccataacgcccgataggagtacggatgccgtcacagataaacgcatgggtcatgattgttctccctgtaatggtgtttcctgcctgtcttccagaatagaatggccgagacgatgggcatgaccacgaaaaaaggccacgattttgccgtcctgattgataattctgacgtcatacaagcccgtggtttttccctgatgctgcataaaagcggtggctgtcaggcggtcaccgctgaaggccgggcggataaaatcaatgctacaaccggatgccaccgccgccagcccttcgctgttgcaggcataggcgaaggcagtatcggccagactgaacaggatgccaccatgacagctttgatggccgttgagcatgtctggtttaatggtcatgcttacttgggcgacccctgtatcaacatggtcgatgtgcattcccatattctgggcgcaggcatctttggcatacatggcttctatgcagcgttgagccagttggctggaagcgttagcggacatggttgcgttccttattttgattttgatctcgctggagatgcagcgttacatagcctgccgccagttggcgcaacaaaggtgcaggtcggtaacggggttcgccataaaattgctgtaagttttccagtgtgctgagaatgtgccgccagcccagttgttccccccatgccaatgggccgatgggataattgacgccgtaacacatcgccagatcgatatctgcagcgctggcgatgcttttattgatggcatccagcgcctcgttgcacaacatggccacggtacgcatcgtcagtaaggcagggtaatccggcaggagaatcacctgcttgccgagagattgcaggaaactgatcacttttgccgtctgcggccgggtgttctggcaggcggagctaagagtgatgatggaagccgtctgatgattggcggcaagatcaaactgtaccactggcgctctgatttcatcagcaagctgtgcgctggttttaccttgtgtcagcgttaatataacgtcatcaagctgtaatgctggcggctgggaatcggtatttttgctttcttcgggggcgattccatattgttgtaacaacggttttaatagcgcggcaaaatgtggcagagttccccaatcgcccgttgcctgaatccgcgcaggccgtatttgctcctggagggtttccaaccggggtaatggctgatgtttttctttgctatcataaacataaaacccctgaccgcgcttacgacccagatgatcggcttccaccagctctttctggcgcagtgaaggctggaagcgcggatcaccgtgaaatgcgtggaacagagattcggttacggcataattaacgtcatgaccaatcaaatcggtaagctgtaacgcccccatcgcaaaaccgcccgattctttcattactgcatccagtgtggcgggggaagcaacgttttcttccagtgcgcgcaaagtctccgcataaaacgggcgggcgatgcggttgacgataaaacccggcgtagagcggcaaactacaggctgtttttgccaatcggtgacgagacttttgagtgtggtaatcgtttgagacgacgtttccagaccctgaatgatttccaccagtttcatcagtggtgcggggttgaaaaaatgcagccccgccatgcgttggggtgaagccagcacacgggcaatggcggtaatcgagagcgatgaggtgttgctggcaaagatcgttccggctgaacagaggggttccagttggcggaacaggttctgtttgacctccagttgttcgataatcgcttcaatcaccagtgcgctcggtgccagtgcctgcaatgagtcaacccgtgtgatgcgctgtaatagggcttgggttgcgccagctgctgctttgcctgcctccacacgttgatgcagacgggtgtgcagcgtctccagtgcacgctgtgccgcttcattattcacatcaaacagcaggacggaatatcctgcctgagcggcgacctgtgcaatgccgatccccatcgttcccgcgccaatgacagcaatcgggccgtgaaggatcggatgatgatgtgctggcgtgttcatggttatctccctttgaactgtggctggcgtttgtctatgaatgcactgacaccttcacggaagtcttcactgcgtccgcacaggcgctgtaaatcacgttcgagattaagctgttgatccaagctattggctgcggcggcataagtggcttttttgatgcaactcagcgccaccgttggctgggtcgccagatgttgagcgagttcccgtgttttatcttctaacgcttcgggttcgacgacctgccagatcatgccccattccagtgcttgttccgcgctgattttgtctcccaataatgccattcccattgcccgggcatggccgattttatggggcaggaaccagctaccgccggcatccggtgtcagaccaatacggcagaaggcttgaataaagctggcggtacgggaagcgatcacaatgtcacaggccagtgcgacggagacacctgcgcctgctgctactccgttgacggcgcagatcacgggtttgggcagggaagtcaggcgacggatcagcgggttgtagaaacgttcaacggattggccgagatcaggaacgtcaccctctgagatgatggcgttgcgatcatttaaatcttgtccggcacagaagccccgtccagcgcctgagagcaggacacagcgcacggattcatcttgttcagcgatctttagcgcttcacttaactgctggtgcatttcctcgttaaagctgttaatgcgttctggacggttgagcgtaatgctgaggacacctgcttcaatatcagtgagtatcattgacatattttccatcgatcagaaccctttgaatgttggtttacgtttttcaagaaaggcggtaatgccttcttggcgatcggctgtccctgccagagcgacaaattgctggcgttcggcgagcagcccttgtgacaggctggtttcgtgtgcagtcttgagtgcagctttagccgcccgtaacgccagcggcgaaaactcactgatgcgttgggcaatctgttccgcgcgttctaatgtcagagcatcgatacagacttcgctcaccagccctgcctgctgtgctttctgggcgttgatcgcttcgccagttaggatcatttgattggccagtgctttgcccacacagcggattaaccgctgtgtgccgccagcgcccggcattaatcccaatgtaatttccggcaggccgaagcgggcactttcaccgcaaatcaccagatcacaggccagcaccagttcgcaacctgcacccagtgcgtagccattgacggccgcaataagaggtttgctgatgttgtgcaagcgctgccagagttgtgggcggcggtctgtcattgccgtggcaacggtctgctgctgtagctccctgagatcggcacccgccgcaaaatagcgtgatgctcctgtaatgacgatagcgccggttccggtatcggcatccgcctgttccaattgctggacgagctgctccagacaatcattgctgagggcattacggacttccgggcggttcagggtcagtgtgcgtacccgttgttgctggtggcataaaatccattcgtgactcatggtagctcctcatttttgacggtgctagacgtcaaaatccacaaccacgccgtcacctttcggccacgactggcagcttaagatataaccggcagccaattgatccggctcaaggctgtagtttacgttcatgtccacttcaccggatttgagacggcatttgcaggtggcacacacgcctcctttacaggcatagggtaaatcggcaccttgacgtagtgctgcatcaagaatgctgtcatcttcggtgttcatggcaatgttcagggtgcggccatccagatgaatctccacacgggtttcactgcgttcggccagattggccgggcgggcagcggtacttgatggattacgcccggtgttgaagcgttctgtatggatacgttcggacgccatgccggcctgctcaagtgcagatttggcatcatccagcatggctgctggcccgcagagaaaggcctgtccgaactggctgaaattgagcaggattttgccgaggtgttgaaggtgctcgctatcaatgcggccgttgaacatcgggctatcggtgatttcctgactgaagaggtacagcacctgaaaacggtgcaggtagcgatttttcagatcggccagcgcttctttgaacatcacggaacggctggtgcggttaccgtaaatcagcgtgaaggtgctatccggttccagcgccagtgtacttttgatgatcgatagaattggcgtgatacccgaacccgcagcgattgccagatagtttcccgcgttgttcccatcgggatggtggccgaaattgccttgtggttgcatgacatccagctcatccccgactttaagccgctggttgatgaaagtcgaaaaacgcccttgataggtggccttgacgccaatttgtaatccatcgtccagtggtgaactgcaaatggagtaacagcggcgtagctctgcaccatccacccgcgccttaagtgtcaggtgctggccgggttgatagcaaaagagggctttcaactcatcggggacatgcagtgtgacggtcacggcatcaggtgtttcccgctcaatcgctgcaatgcttaagcggtgaaaagtcggacgatgaaaagtagccatcttttgctgctccctaaactcaaatacatttgaaatagtcgaagggttccagacactgctgacagcgatagatcgctttgcaggcggtggaaccgaattcactgattttttcggtctcatggctaccacaacgtgggcaggtgattgtttctgtttctgtcggtttttcacaagccagaccttgtggaggcgcgataccgaattcccgcaggcgttgtttggcatcggcattcatccagtcagttgtccatgccggcctcaggctgatttcgacagtgaccgatgtaaagcccgcccgtgccagtgtttgctgaatctcattgatcaggtattccgttgccggacaaccggagtacgtcggggtgaatgtcacccgccagccggttagctggggggtcaccgcccgaaccataccgagatcagtaatggagagtacgggaagctcaggatcggcaatctggtgtaggcattgccagatctgatggatggccggattctgtaattgtaatgtgttaacgtgttgttccatcttcccctcccttcgtgatcaacggatggttaccagttacagttgggataagtgcgttgcagatactgcatttccgccagcatgtatcccagatgttcggtatgcagtccctgcttgcctccctgtcggtagggcgtttcctgcggaatttccaatgtggcttgggcgaatgtctcgttgataatttgccgccagggttcgtacaaggtacggggatcgaccgcaatgccttcttcggccagccgctgttccacttcatcgcaatagaacagttcgccggtaaagcgccacagttgattgaccgattgccggattttttcgcggctcagttccgtaccatcccccagccggatcatccagccacggctgaaacgcaggtgatattcgacttctttcaacgatttggtgctgatagcggccaattgaggatcgcggctctgccccagtgcctgatggagcaggacgtgataagcatcgataaaaaactgacgtaccagcgtatcgttaaagccgccgttgggttgctctaccagcagcagattgcggtattctcgttcatcgcggccaaatgccagccgatcttcatcaaaatccattccgtagagtgtggcggcgtagctgagaaaatggcgcgcctgccccagcagatcgaggccgatattcgacagggcaaggtcaatttccagttctggcgcatggccgcaccattcacacaggcgctgtgccagaattaacggggtatccccctgccgtagcacataattaagcaggtcatggttggatggatcaacgctatgtgtattcatatttcagctcttacatattcttgatgccatcaggaatggtatagaaagtcggatgacggtagattttgtcttccgagggatcgaaaaaagccccgcgctcttcaggttgtgatgccaccagatggatagatttcactacccagatggagcaaccttcattgcggcgagtgtagacatcgcgcgcgttctccagcgccatttgatcatctgctgcatggaggctgccgacatgacggtgagccagcccctgtttgctgcggataaagacttcatacagcggccaatcggtatcactcatattttgtctcctgttccggttatcaattccggtaatgaaacggattaagcagcattttttctggtggccattttcttggcatggattgaggcggcttcacgtacccagcttccggtttcccaagcccggcgtttggcttccagccgttcgtgattacatatgccctgtcctttgagcacttgatagaattcgtcccaatcgatttcaccaaaacggtaatgttccgtggttgcatcccagaccagttcgggatcgggtgcggtcatgcccagtgcttccaattgcggaacggtgctgtcgataaatttctgccgcagttcatcattgctgaaccgtttgattttccatgccatgctttgggcgctgttgggtgaatcattgtcattggggccaaacatcatcagagtcggccaccagaaacggttgatggcatcttgcagcatcttgcgttgggcgtcattgcccgccgccagtaccataacggcttcataaccctgccgctggtggaaactctcttccttgcagattttcaccatcgcacgggcatacgggccgtaagatgcccgacacaaggcgacctgattgatgatcgcagccccatccaccagccagccaatcacccctacatctgcccaattgagggtgggatagttaaagatggatgaatatttcatcttgccattcagcagcttctggtagatgtcctgacgggtacagcccagtgtttctgccgcgctgtacagataaagcccgtgtccggcttcatcctgtacttttgccagcagcaccgctttgcggcgtagtgtcggggctcgggtgatccagttggcctccggtaacataccgacaatttctgaatgggcatgctgaccgatttgacgtatcaggttttggcgataggcatcaggcatccagtctttggcctcaatggaaagatccgccgcgattttggcgtcaaagtgcgcttgaagtgagttagttgtcatgttgcctccgttatgattcttatttttttatttttaatataaaaatgaatcattttacataactgtaaatctacaaattgataacgtaaatatcaaacagttaggttgtctatttgtagtacacatcacaatatgaatttttatttttttaaaaacaataagttaatttttattattggataggataagaatattaacaagtgatcgcccgcaaatgttttgcttttgttaatttattgggtggtttcgttaatgggatatatgatacataaataccattagatacttgataattgattcattaatttgttaggtggagaaaaaatgcaacagttaaccagttatatttgtggtgcttgggtttatggacagggcaacgccagaacccttcatcatgcagtgagtggtgaagccttgtatcaggtgtgttcagatggcctgccactggccgatagcctaggatatgcccgtgaaaaaggcggtaagtcgttgtccgccatgacgttccagcaacgtgcgcagatgatgaaagcggtggcgaagcatctgcttgctaacaaagaaacgctgtatgccatttcggcagaaacgggagcgacccgtgcggatggttgggtggatattgaaggcggcattgcgacgctgttttcttatgcagggctggcggggcgtgagttaccggatgataccctgtggccggaagatgaaatgatcccgctttccaaacagtcgcagtttgtggctcgtcatgtgttgacttcgcgtcccggtgtcgcgctgcatatcaacgcgtttaacttcccttgctggggaatgctggaaaaactggcaccaacgtggatggccggtatgccagctatcatcaaacccgcgacggcatccgctcaattgacgcaggcgatggtaaaaatgatcatcgatagcggtctggtgccggaaggcgctctgcaattgatctgcggtggcattggcgatctgtttgatcatctcgattatcaggatgcggtgacttttaccggatcggcgcagaccgggcagaagctgcgtgttcacccacgactgatcgaaaaatccattccgtttaccatggaagccgattcccttaactgctgtatgttgggcgaggatgttacgcctgaaatgccggaatttggcgtgtttatcaaggaagttgtccgcgagatgacggctaaggcagggcaaaaatgtacggccatccggcgtattatcgtgccagtcagtcagcttgaggcggttaaacaagcattgcttaaacgcctttccggagtgactgtcggcgatcccgcactgccggaagtgcgcatgggcgcgttgattagccttgaacagcgcgatgaggttcaggccaaggttgatgaattgttgcgtcacggttgtgagcctctgtgcggtggtgctttggatcaactggtgctgacaggcaattccagcaacgagggcgcattctaccctccgactctgctctattgtgctgatccggtagcacatcaagcggtacatggaacggaagctttcgggcctgtttccaccttgatgccgtatcaggggacagaacaggcgatagcgctggtgttgatggggcagggcagtctggcgggttcgctggttacggcggatgagcagatcgcggtgcaggtgatccgggcaacagcgtgtgctcacggccgtatgctggtgctggatgaggcggcatctgcggaatctacggggcatggatctccactgcctatgctggtacatggtgggccggggcgtgccggcggtggcgaagagctaggcggtctgcgggcggtgaaacactatatgcagcgcaccgcgattcagggcagcccaaacatgctggccgccatcggccgtgaatgggtacgtggtgccaaagttaagaccgatccggttcatccattccgtaagtatttcgaacagcttgagattggtgaaagcctgctgacggctcgccgtactgtcaccgaagccgatatcgtcaattttgcctgtctgagcggagatcatttttatgcgcacatggataaactgggggcggcggaatctctgtttggtgagcgtgtggcgcatggttattttgtcgtatcagcagcagcaggcttatttgtggatgcagcggttgggccagtgcttgccaactatggcatggaaaacctgcgttttattgagccggtgaaaattggcgataccattcaggtgcggctgacctgtaagaagaagatcaagaaagtccagaaaactcctgatgacaaaccgcaaggtgttgtggtgtgggatgtgcaggttttgaatcaggagcaacaaccagtggcgctttacagtattctcacgctggtggaacggcagcaaggggattttaccgcgtctgagtcggtgcggttgagataaacaaatcggagatttgttgagtaagggaactgaaatgcctgaggatatttgtcaaaaaaacaaaatagcggtgatcctcaggttgttctctaaagtttgaattcgggttgcattgcacttgacgaagccgacggctggttagcaaagctcgaagcaggagataatacgcattaagtgtacacgtaatgggttgatgatattattttttattttaatcgtatttcttaaatatttgtcaagtatgttatttctaactcagaaataatgaaatttctttgtgatattgatgacctgtcctcatttttaatgaaattaaacagaagaaactatatggatattaaatagttattgtgatagttatttgctatattattgcgatattttccacataaaataatcaatattagttcactataaattcaatgggtatattggtattaaataaataattatttttctttaaatacggctaattatatgaattttatgttatttgaatataatattaatgaggttaatattttaattggttatatttcatgatgtaaaatgttaatatttaaaattaaaaattgggttctgtatcatcaattatataaaaatgtgatttgactaaagttaaattcaatgtaatagtcaatatcaagcaaatccatttattaacgcctgatgatgtttcctattttggtcttgttaatccaaaataccgggtaaataataaaaacagatgaaataccttatgtaatgcagtaacagaagggatagtttgtttaatgtttaaattaaatgataatcaggcgttatattttttgcttttttaatcaagttaccgctgttttgccttttttattgaccgcttttctgaaaaatactttcccgcaaaatacgcatcactgtttctgccccgctgcgattgggattaatgcggatcatgcgtttttccagtgtaggatctgcctgacgaaatgtaccggaaatgcggtaaaacagcggcgggatttcaaacttggattctgcacccactggataaggtaatgctcccaacccatgtgcggccgtcagtactgcttcggcgatagggtcgtgaaattccaccaataacactttggattgagcattggccagaaatgcctgtttcacctgtggcaattccccctgattcaatcgtgtcaccaacgtttcattaacttccgcctgtactgcatgtatcactggcgcggacaccagcccacgcaatgcttccattgcctgatagccttgtatctgacagccaccggagtacatgctgcggcgtagggtctcaatcattgtttgtttgccgataactaagccaactccctgtggccccagtaacttaaaacaggaaaaactggagagtgtcgcgccatattcgcagccaatatgcgccactttcatggctgcatagttatcatcgaccaatgagggaatttgatactgatggagtatggcgagcacatcttgcagggcgtagctgtcatctatcttttgccgtgtatgctggatcaggctggcagcaggttgatattgccggatggccgctgcaatttgttctgtatgattgaaatctgcatacaccacgtgaagccccatttgttcaatcgatatcttggtcgtgggataaatcggtgcatcgtggacgagcaatgtagcgttgggactgactaatgccgccagccccgcgcgtagcgcccctgttccggctccattgacaaaggctgccgcttcagcaccaaaatgctccgcgatgaccgcttcaatgcgatgggtcatccggggttggtgcagatccgggactaagcccagatcaccttgcgagagaaaatcagcgccgggaaagtgacgacagataatatccaccagtttgaactgctgctgctgggcttgcgccatcgtcatactttgcaatggataggttttcatttgcttattttattcccagcagatagagcacgttggcaaggatacccaccgcaatagttgcgattgggccgatagccatctctaccaaaggacgtctggaagtacggttgagcaggtagattcccgccacgatcataaagcctatacccggcaaaatagcgttggaggcaatcataccaccaaccagcagggcgacttcgagcattttggtgatcgcggtacgaatatggccactacaggcttttacgccggggtatttatccagccaaatggcgattttcgccagcagctggatttcaatgaacatggtgatgccgcccgcaataaaggcgatccacgggttgttggtcgccagacccgccacaaacacgaatttcatgccattcgggctgtaaactcccgtggctatcgccgtggtgccgaccagcgggataaagctgatggcgcgtgccagtgcgaccaacagggcgttggtctgttcgccctgcgccattaattgcagggaaaccgggccttcggccagcaggctgaaagacatggtcgcggcacttgcggtcaggccgccgcagaggatcagcagccatttgtttttctggatgcgttcaatacgggtagagaacagcccgactaagacttcattggctcctttctgctccgctgactgggctggacgctcccgcatcgcaaagtagaacatggcaatcatcgacaacagtaatgctgcgccgttgggatcgaaactgaccggcttttcgatcatgccaccaaagctgagtgggccaaccgccttggtggccagatagcctatcaacgcggtgagcatgacccatagccctttgcggtagccatattgataacccacaactattgcagggaacagcgcgaagcaggcgacaatgggatcgccaactttcttgaggtcatcggtgaaattcaccggcagcatggcaaacagttcgacgactgagcgcaggccggcgagcaaggcaatagcatacagggcgccgatgatacccgaggcgataaaccctcttcggctgttggcacaccagatgccgatcatatcagtgccgagcagcaggctgtgaaccagcacaatcggcgctgccagtgaaaagggaatgccaaaaccgacaaccagaccgatgctcagggcaaagctggtcgcagcgagcgctttgcggctcatccggccttcaaggtattccggcagcagcgggcgcagaccatcatggaaaacagcgataccacggtttgccatcatggcggcaatcgcgccaatagcagcgagtaatccggccttgaaagggtcaacttccatcaagctcatcagaaaactgtgaagatgttgtatggcattgatatcactcatgacatgctcctcactgagaaacgatggtgttgatgatcaccggcaggacaacatcaatatcctgacctgtaaaaccgaatgcttttttacctgctttcacatgggcaataatctcgtcgtcagacaggattttacccggcatactgatggtggcacattgattcaggccgataagtgcgatggcgattgccagtgcaccaccaccgccggtattgcatgcaccgagatagtaatctgcatcaccatttttaatcgccatagcggcttcaatgtcattcatgatggtaattgcagtggctttgtctcccgccaattgccgaatgctttcggctattctttctttttctatttgcccgccaatgacaaatttcatgctgttctccctctctttttattttgtaccggattgctgattgattgaaaaagctaattttcggaaaatacaggggttagaaaatttaagtcttagaaaagccgtgtcggaaaaattgtgcaggattatcgcgtaacatgagatctatctgcgtttgggagaaaccagctgccagtaacatcggcacgaatacggtcaacaggtaatcgaatccaattcccccgttactttttaaatgagaacggcgagtgatatcctgggatagcatcacttggcccagcagaccacgtttggcgacttcccgcaacatggcaatgcgcccactgtctggatagtagttgtttttgccaatcgtatcgaattgtatccacgccccttcttcaagcaggggaataattgtgtcgagattatctttcagatcacaatgaccgatagccacatgttcagcggaaacgccaaattctttgagcagagccagttgctcacgtcccattgtgcttaaggtggtatgggtggagatagggcagccagtggcatgatgtgccagagcggcggcggcaaatactttcttctcatccgctgtgatttgatcaaggctggaaccaatttctgctatcacgccggcttttagcccagtaccgtcaatgcccgtttcaatttcagcaatcatatcgtcggcaatcgcctgtacactcaattcgctgaaatgagcggggaaaaatggttctttatagtaacccgtcgaagcaatgatgttgatgtggctatcacgcatcaaatccagtaggaagttagcattgcgccccatgtagcggttggtcatctccgcgatgttccgtaggccaagggtataaaggtgacgaagttcatcgacgatcagatcatattggtctaatcgacagtcgagactgcctttcgcaccagagagatcgatatgcaggtgttcatgcacataggtatagcccgatgtatcaatacaggtattttgctgtgtacccagatgtgggttatttaattgtttgtttgatgaatatagcagcgtctcaccccgacgtttaacctgatattcttggtagtccgcctgtttgagtgcgtcttcagcttcatcaattctggatgaggaatacgtagcggaatgtgtgggcgtattcccagtttgtttctggtatcccataaatatttttgtagcatcatgtggtaaatcgactggagcgaaaataacattatttaagggataagtgatattaactgtaatactttgattggatgattattgaaaataacccctgtttttccaatttccttgactgtcataaatgccttgaagctttggtgaaccggattgaatgccggaaacgagagctacgtcgctgcgggtgacaaaaatctgggtacggaagcacatgatcactgggctgccgataggatggataccggatatcgggatatggtaatcaatgcagggatctcccagactcagtacccgcacggttttgggggagcgcgcatgttcagggaaaaccagcgcgtatttcatatgtccacgtttatagtagccgccgccatagcagtaactgttgccgtcgtagtgatgggaaacctcggtgatataaaccattgagatcttttcaggttcttggccactgatattggcgggtatcgtgccggtcagggcatgtcccggctcaaggtgggtagcaccgtattttgccagcagggggatggtgttgcagcttgatgctgaaggcgcattgatttgtgagagttcaatgccaagctgttcaagtctgttgcgcgccctgaggagggtctgcaagttgatggtgggcagggttgtctgatatcgggcgttccactccaggcaggggaaatgggttaaaccgctcaacttaatgcccggcatggtttttaatacgtcaacggttgtatccagttcatcgaagaagatacctgcttcctgagagggtaaagtgatatcacgcttatcaaacactttcagcatgatgggctgaatccgtcccaatttctctgcggcatctgagatcgcctgtgctttttcaatggaaaacaccgtaatgatacccggatgctgtttaagcatggtttctatcaggtgtgcaggggtttgtaccaaatgaccgatgtggcatagcggtatgccatgctgactcagggcatatgcctccctgaaatccacggccacgacaccagggtaaccgagttcaatgagcttttgagccagccagggattacggccaatctgtttggtcatcaaatagagttcaatgccatattgctctgctgcttgcagtaaatgccgaccattgtccaagacctgatcgacatcaatgatgtaagtgtctggtaatatcgcgccttgctgccaaaggtcttttgctatttcaatcaatttggggttctgttttttcagggcattgataaacatcggcttcccttcatggctgcaatgcggcacggctgtgtgaaaattaaaaagactgagaaattcaaatattcatttttttgaatatttatagtgtaaaacaaaattcagggaattttggttgccagtattaaaccatataaatttaccaacagatagccttcttcgttggggtgcagtgtgattgtgaatttttctaacaatgcgcgatggattttgaataattgtgcgcagtgttctgactgctcgattttggtcaagatattcttttcaagtggcaaaacaatttcgccgcgacgtgagcgcatgaaagcactcgccatgtgggtaagcgccatttcaccttgtggatgatggacagggattaaccagatatcttctagatcatgcacaatatcaagcatgttatcgtagatatcttggtcgatgacgccaccttgcaacaggatagttagtcgttgttctaccattgctttttgttatacgtcaggttaatcatttgatttggtttattgagcgtcaataaactggctcgattgtgcctgcgaccacgttttgttgatgagtcagcagtgcttcccgatcaaccatggtgtacaggagttgctggatggggatgttgtccttacgagccaaaataacggcttcggaggctttgataaagcactcactatcatctggaagctgagtcatcaaaccttgtgctaccagttcgtgaccctgcccgacgttccaaatggccgcatcaatgtggcctttcatgatttgattcagacattcgtgataggagacctcgaccacttcaatctcttttccttcaaaatactgattcgtcattattttttggtctgctgaagtactgtccaacccaacccggcgaatggaatccatttcgccatgacgaaagattaatctatgcctgtctgtataactttgtgtccctagtgaaagcgcaatatataaatctttattttctgggtgctgctctgcggcaagtcttgacgttactgctaagtcatagacgccattcagtaagcattcaatgcggatgtctgaaccacgcatatgtgcaaaataaaaaggaatctctgcacacaatgcttttaaaccactggccagaccttcataggcgcgggtataaggaagcggcattgcgcagaccacattgccgatatcggcatactccaagagtaatttatggttaatctgcgaaagaaagctgccattacgaccacgacgcttaattccaaccgcttgtgcctgttcaagagatttcaatgctgcttgcattaaacctacggacaatccacattctttagccagtaactcgatagttttcaggcggttgccacattgctcagagaggagataacgagctagaaacgattgtgcaatcccctcttttttaatgaatgtttgactcatcatagtaagcttttatccattctggtttattttcataaatttgaacataaatcgcaataagcgaattatagaaaggggattaatatcacaactgaaaaaaaaatgaaaatttaaaaaagcaataaatataaatattatcaatatcttgaatgtatatttaaatttattactgaagatataaaaatcagcgttatgggagaatatagggaaatctgcgtgtagaccctatctgtctgctgtatttaccttactgtaaggtgatttttgctatactatttgttacgtaatgaaatggttagattatattttgcttattgtttttttagtaatcaattagaaatttaaatgaaatagatgcattcttcacctgttttaggttattactatcttatctgcgttatttttcatataaagaaaataataaaatcattatcatattggtttagtcataatatgcagggtacttttctgcttggaacgggaaaagataatatttttgtaccatttcatcccttttctttcatagaatttgatggctaatgtgttctgttctaatacttccagccaaagccattgcaacccctgctcctgaccgagtttgactatatggtcaaataattgctcaccgtatttttgtccggtctgatgtggcatcagatggagcttatgcaaatagacgccagttaaatcgctatcagggagcggttcatagaagacgattttggcaaaaccgactgagtgatgagtttcagcaataaaccacttgtgattggtggtgttgagtgagttcgatattttttctggtgaaccctcttcggcgacatattcttccaattcggttttgttatgccacaaataggaaaagtgaaaacgatagctttcctcaatgagctgggataacagcaccgcgtctttgattgtcgcttcccgaatggttaacatagagtaacctccaaggttaattagatcagcttttcgacatcctaccatgccaatagaaatatgatgatttaaataaccagttgaataaaattaaaaattaagaaatctcagtagaaagtagggatgatttatttcgaaactttatggtcattttcaggaaagaaaatgagcgggaagatacttttagggtaggaatgaaaaagattatgcgagaggaaagataaaatggcgataatctcttatcgccatttttcagcaagggtagagttagctttgtgcctgacttgattgaacgttctgtgccagccagtcagcaacccgctgtttctgttcatcggtcagccacatacccaatttagtccggcgccagatagcatcgtctaactgagtcacccactcatgttcgaccagataacgcaactcggcttcatacaggccgtggccgaagaactcgcctaaatctgtcagggcttctgcgcctttcaggattatctggcagttgctgccgtaagtacgggcatagcgttgtgccacaccttctggcagccagttatgacgctggcgtagcaggcgtgcataaccatcgcgatcatggccttccagttcaccacccggtaatttaccgtttttagtccacgccttacctgcgtttggatagtactgtaccagtttctccagcgcgtgttcagccagtttccggtaggttgtcagcttaccgccaaagacggacaacaatggcatctgcccctgttcatcctgtacatccagcgtgtaatcacgggtgatcgcctgtggtgaatctgattcatcatcgcacagtgggcgaacgccggagtaagtccagacaacatcactacggttaagctgtttcttgaagtggttgttataaactttcagcaaatagccgatctcttgatcgtcaattttaacttcttttggatcgcctttgtattcaacatcggtggtgccgatgatggaaaactcatcattccacggaataacaaacacgatacggttatcttcgttttgcagaatataggcttgaggttcatcatgcgcacgaggtacaacgatatggctgcccttgatcagacggataccgtaaggtgatttcagtttcagcccatcatcaaagaagtttttgacccacgggccagtcgcgttgactaagcctttggcgcgccatgtatcggttttgcccgtggtgagatctttcgcttcaaccatccagtaacccttttcacgccatgcgcgggtcacttgagtacgggtacggacttcaccgccatgcttctggacttcctgagcgttcaggacaaccagacgggcatcatcgacccagcagtcggaatattcaaagccacggcggatggaaggtttcagcacggaattcgcaccaaatttcagccccttgctgcttggcagactaacgcgtttacccaagttatcatacaggaacaggccaatgcggatcatccaggctgggcgcagatgcggctgatggggcaggcgaaaacgcattgggaatgcaatatggggtgctaatttcagtaatacttcacgctctgccagtgcttcactgaccagccggaattcataatgttccagatagcgcaggccaccgtggatcagcttggaactggcagacgaagtcgcactggccaagtcttgaccttccaatagcaggacggaaagtccccggccagcggcatctgccgcaatacccgcgccgttaattccgccgccaatcacaatcaagtctttggtttccattacatccccctctgaaatgttcggaacagttctttaatgctcgttttcgctcaaaagattgtaatcaaaatttcatcaatcgccaacctttaactaggaaaaaacctattcgcgtgatgcagataacaaatttttatcatatgtataagattaataaggaatttgcgggaagcaaattgagggcagaaatttgggagcaggggcttgcaacgggaagccccaccttattcatatttcaggtggggaaatgaataaaatgtgattagcacagttccagtttgacactatgctgctcaatgattttctggatgctggcaggaggcactttatccgtaaacaggaaatcaataagattcatgttgccgaggttgaccatcgcactacggccaaattttgaatggtcggcaaccagcatcacgcagcgggagttctcaataatggcgcgtttggctcggacttcatggtaatcgaattccagcagagagccatcgctatcgatgccgctgatcccaagaatgccaaaatcaaggcggaactgggagatgaaatccagagttgcttcaccaataatgccgccatcacgggaacggacttcaccacccgccataattaaccggaaatcttctttccccatgaacaggctggcaacattgaggttgttggtgacaatccgtaaatcccggtgattaagtagtgcatgcgcgacggcttcgggagtggtgccaatatcaatgaacagggttgcaccatttgggatctgggtggcaacctgccgggcaatacgggctttttcatctgaccacatgattttacggtcatgataggcggtattgacggagctggagggtagtgcagctccgccgtgatgacgctggatcttatttttgtctgccagatcatttaagtcacgccggatggtttgcgggctgacatcaaagtgttcaaccagctcttcagtgctgacataaccttgaaggcgcaccagctcgattattgcatcatgtcgctgagtttgcttcacaacattcccctaatgttttgcatagatggattataattgaccaacgttatttggaatattattaatttttttgtttacgtaaattatcccatagccccatgagtaagccgatgattaaccccgaaaaatgagcagcattggcgatattcagtgaaaacatatcgaaatagccaaccaataaccagatgaccgagatagcgattaaccctctggggacactgatccctcttttgggggacatttcacccgtcagccaaacgtagctgatcagtgcgtagaccacaccagaaagcccaccaaaatgcgatccactgaacaaggattgtgcccagtcagtgaaaaccgcagagactatcgtaatttcaaagagttttccggcacccatatgcctttccacctgactgccgagataccaccataacgcgagattgaacagaagatgtgtcagggagaaatgcagcagggcagggctgacccagcgccataattccagatattgttcaccattaggccacgctagccagcgcatgacatcggaatctcctgccacctgcatccatagataaactaagatacagagagcggtcacggagatagtcagcgggccggactgacttttcaaggtgctcaaattcaggctgttgtgatatttaaatgaataacccgatttgccagcttgccaactggcggtttgatagcgctcattgaatggatcgcgggaaaattggttaagttcctgctcaacaaaacttaactggttttcatcttccagccacaattcaaccagtgctggctcatgggtaggacgcatggtcaagtgaatgccctgtgtcaccatataatcaataaaggcttgagccagtcgtggattggatattgaggttacgtggatcattgcgcgttttatctgccttaagttgaagttaatcgcacagggctaattagattagaatcagtatgttaagaaactatagcgtgttaacagcctcaggatagcttctctgccatacgtcaaagccaccattaacactgtaaacggtttcaaaacccatattcacaaggtattgtgcggcgccttgactactgtggccgtgatagcacatcaccatgacaggctggtcaaaatcagtttcttgcaggaggttattgagggtttcattggtcagatgaaatgcgcctgttgtatgtccggcacggaaactctgtggatcacggatatccaccataacagcagttttattcagccaatgctggtaggcttgttcagggtttattgtttgaaaacggtccataaatactcaatgttatttctaatactttccatttaaaggcattaatttcttaataatcgtctttatgactttacgccttcccaacgtttccattggaaaggcgtggaaatactggctaaaaatgctaagaacagaaaaagggtcaaaaaatacaaatcaagaatcagtaataagagtgttcgccacgctggtgttcagtcaggtctctgacccctttcaactcagggaacatattcaacaactctttttctatcccttctttcaaagtgacatcgaccatagaacacccattacaaccaccgccgaattgcaggatggcataacctgcatcggtgatttccatcaggctgacacggccgccatgacctgcaagctgagggttgatctgcgattgcaggacatattcaacacgctcaatcagtggagcgtcatccgtcactttgcgcattttggcgttcggggctttcagggtcagctgggagccaagttgatcagttacaaaatcaatgacggcttctgccagaaaaggagcactgatttcatcaacataggcagaaatctggtcaaattttagttcggtatcagtggcttcaacagcatccggtgggcagtaggaaacaccgcattcagccgtcggggttcccggattaatgacaaaaacgcggatctgtgtacccggttcttgacttgccagtagcttggcaaagtgcgcttgcgctgcttcagtaatattaatcatgtcatttgctcaatagttgactgtaatagttgactcttctagttggttataatacgcccatttataaaggaactacaaggttcggcatattgcccaagcttgcacggagtgagcacccgcacgaatcaacaactgtgaggcttcatgcaacgttgtccccgtggtgatcacatcatcgaaaatcgcgacattttgatcggtaaaatcgccacgcaattgaaaggcatgcttaagattggttttccgttgagtggcagataagccccgttgtgtgagtgtagcacgcgagcgccacaaaagatcgggctgatagtggcattgtaaccagcgtgataacggcttggcgatcagttcaatttgatcgaatccacgtcgccagcgttttttgctgtgcagaggaatgccgagtatacaatccggcttattccagcggccatcacgataaccctgtaaccaatgcaggagaaacagacgggctaatactgtcgcgagttgtggggtgccgtgatatttgtagcgtcggataagccggcttaatggcggggcatagtctgtaatggcgatgaggtgttgccacgggggcggatttttcaggcagcggccacagggaaaatctcttgattcggcaggcagagcacagcgcggacagacatgtttcagccgttttaattgctggtggcagatatggcagatcccatgatgagcaaaatacaaactttgatggcatagccaacagtatccaaccattgttagcataggttccttccttgatgacaaataagatgagaataacaatgaataagttgttttggcagataatgggtgaggctccacgcgatcttgtgatgctgcacggatggggattgaattctgaggtctggcgttccgtggaaacgcgactgtcttcgcatttccgcttacatctggtggatttgccggggcatggtcgcagccagccgtatccggcaatgactctggcagaaatggcggatactgtatggcagcaggcaccggagaatgcgttgtggctgggctggtcgctgggaggattggttgccagccgtattgcattggatcatccggcggaggtcgcgggtctcattaccgtggcatcttcgccgaagttcagtgcggaaggtgactggccggggattaaaccgaccgtattgagggcttttgagcatcaactgagtgaggatttccagaagaccgttgaacgttttctgtcattgcagaccttgggtactgacagcgcacgtcaagatgcacgtttactgaaatctgtgatattgaatcagccgatgccgacagtggaagtactcaatgcagggctggaaactctgcgtaccgatgatctgagggcggaactggctcaacttcagctaccttttttgcgtctgtatggttatctggatggccttgtgccgcgtaaaattgctgcacaactcgacaatgagtggccacatacccattcggtcattatgcgtaacgcggctcacgcgccttttgtttcccatcctgatgaatttgtggatgccgtaatggagtttgtggctaacgcaggattgtgattattgcgtattacccataacttgttagttatgggtaattgaccgtttatctggaaggataaacttcagtgacaatttcaggtgcattgaggatggtatcaagaacagggcagttgctttcgacaaaatcaataaaatcgcggatctcttgttcggtattatcggctttgatatagaatttggaggtgattttggaaaaccccattttggtgtttttatttcttcctgtgaagccgtcggtatccaattccccttccatttttacctgaatatcaatcaagttgattttatgtttgcgggcaaaacttttcgccacaatacattggcaggcaccgaaagctgaaagtaatgcttccacaggattcatggcttcatcagttcctcccagatttttgggttcatccacatggaaggaaaagccacgtgttgaacattgcattttgaggtgaccggatgattctatttcagcagtaaataactctttaggcatattattatcctcaggttattaaatattgacagcactaacacccagataataagagaataatttttatttttcaatttatgtttgaggagtgaggttttatttttcaattcactatcggccgattaatgcctgataaaagtgacaataatcacaatgttaaggattatattataaaggttattattttacttattattttgagtcatgacttcaaagcgttaatttgatattcttgaactttttaatgggatatcatcatgactgttacgatagaagtgacttgtcgatattgcgaccaagcagaacctgtacgcaaacacggaacaggtaaggctggcttccctcgctactattgcaaaggctgccaaagaacctttcaactcaactatcgttacaacggccataaaccgggtatgaaagaaaaaattgtggatatggcaatgaatggctctggcgtgagagacacaggccgtgtattaggtctcggtatcaatacggtgatgcggacattaaaaaactctcgccaaaaaaagtaacatcgcgacagatcgcttatgacgatgtcacacttatctgtgaattggatgagcagtggttttttataggcaataaaaaacaacgtcattggctttggtatgcttttgatacgaaaaggaaacaagtcatcgcccatgtctttgacccccgaacggatgcaacctgccgaaaattgctcaacttattggtgccttttaatattcgtttcatcacgaccgataacgggggaagttatgccagagaagtggtgccggaaaaacatagggtaggcaaaatttttacccaacgtatagagcggcataatctcaatctgcgaattcatatcaaaaggttggcaagaagaaccatttgttactcacgttcaatggaaatccacgaaaaactcattggcgcatatattgaaaaacatcattacaaccctttggagtcatgaccaaaaataagacaaccacggatgtcaagtcaggccaacagctcaggtattacggtgatttcgttcgatttttctgctgttttctgttgcctcagtaccttcttgttttctgtggcaaacgcactcaccatatggatggttgaacgccgatcttcacggtgataagaggcgtgtcatgttttaccatcaattgcgattaaactgctttcagtgagttgattcacagtctgcatccagctggcattgctggaattgacgaggttcaatacaagcaatgacccgggcaaatagtgccatgcacagggataccgactttgagcagccctttcttttgaaatcatttaaggtgaccgttgccgtagtcttcaatatcttgtcagccttcagctccggcgatgacggcgcaaacggttaaaaaaagaatatcaaaaagggggtattggattttaaatgattgtctactatttgaccgaaatgcagtgaaaatgcgtcgatattcatagggattatcccgaaaaggagcgtatgagatcatatccgtccttgcaggtcaaatccggtttttgttaacaaaatcttcacgatcttgccctaatggaatacctgtcccttaagaatgttctgaatatcatattatttattaattttttattatatttacttaattttttccacactaaaactcaatataatataatttatttttggtctaatgtattttgtttgtgcttgaaatatacattttttgcgtatttatggcgtaattaactaaacatagtgattattaatttaataactactattggattgcaaataaaaaaaattcaaccataataggtcatctgaaatttatataattattattaacctgacggcagtctatgtcgtcacaaatctggagcttatgcagatttcagctacataaactctgatctaaatcaccaccaggtttatattattaagtaatgattaggcattttgtggagaaactatagtaatggtaattcttggaaaatatcaataggtctgattagatggtttgtattttaatatatcggatgatcactcctttatttaccaaaacagtggtaagcgctgaatctgagttttaaaaacaaggcatagatggtttgtctttcgggtgataatgtactgactccttggttagtattccttaaggagtttccttgtctcactattcactagatcaggctgcccagtagaaacagggagaaattcccacattagttaccgctgcaaaatttgctcaatatgtaggtgttaatgtaattcgtgctgggaaaacagctgtgggagagtgatattattattaaacgtcagcagccttgtttgccccttgtccattcagagctagcaggacgtctacatgttgaatatcgccgtgtgatgaatggggtgttctgggtgggggcaccatggcacgatttacctgagcgctatgggccttggaaaacggtctataaccgatttaatcgcggatcaaaatcgggcattatcgacaaaatatttaaccgattactgtctgttcttgatgaaaaaggcttaattgactggtctgaaatttgcctagatggcagcaatattcgcatcagtaaagatgctgcaggcgcgaaaaaaaacatctcgatattgctggcgattatgtgctgggtcgctcacgtggtggttatgatacaaaaatctatttggcaactgacggaaagggctttccatttaacctgatgttgaccgtagggcaagcccatgaaagtcaatccgctatccctttgctcgacggagttggcgtacaacgtaaaaatggcttcatgaaatggcgtggcaaagccgtgttggccgataaaggctattcgggcggaaaaccccgcagttacctgcgaaaattgagactaaaaagcattattctttataaagtcaatgaaaaaggtagtagtgatgggtgtacacaatttgatgaaccgatttgtcgtaaccgcaatgttgtcgaacgctgtttcggttttcttgaaggaaatcggcgtatcacaacccgttatgaaaaaacagcacgaaactatctgtccatggtgaaattgggcagtattcgactcttttgcagaaggttatataattgagtgatatagcctagcgctaaaactattctgttctacggagtgaatattcgtcaggcctataattttagaaagaaccgttataataattattataagataaaacaaaaaatgtgatttcacatttatgaaacagtttttatatacttgcattacattttaaggtatttacaaaaaaaattagatatatattttatgtgtggggaaaacaatgaatattcgtaatagaacaccgaattttgatgacgtagctaacattgtgaaaattctagggataacatctaataatggtgaatcttttgatagagatttgcatctttattcactaatagaaaaaccatgggggtttgaatatcgggtttattgtgattcaatttttgatgtatggaaattacatatatctccacaggaaaaaacctctatgcattgccatattcaaaaagatactgttctcatctgcttaaatggtagtggtgtgacaaaattccttgatggtgatgagtttaatatatctgttggccaagtggtttatatagagcgaggagttttccaccaaactatttcgactggaaatgattaccttgaacttattgaggtagaaaatccaagaaataaattcgacctattacgtttgtcagatgattatggtcgagcggctcaatcatatgaaaatgttagtcttaatcatgacctgctttctccactaaaattaatctcaccaggagcatatattcgaaatgttgacataaactctaaattttcttttttccttgaaaaattaaatattgatatattagatgatgaaaatattttatttattgtcagtcttagtattgatagtcatctttcaggaaaaataaatatctttttaaaagaagatgttaaatgtcgtagctatattggccaacaagtcttactaatatcacgaaaaaataaataaaggtatattttatgttagataaatttaaattggttattattaccggaccaggattccaagatcatgatctcgtttacacttattaccgctcaatagaagagggttatgatgtttccatcgctactaaagatggagaatctgtaattggaaagtatggcatctcagtacctatggataaacgggcaaaacaaaatattacatttgacgatttgaatgaagaaaaatttgatcttgtcattcttactggtggtcatgaagcacctgaccgggttcgtcaggatcaacgggtaaaagattttgtgtctaatatgtctaaacaagaaaaagtagtagcaggcttgtgccatggtccttggatcatgatttctgctggtgtgatgaaaggcaagttagcttgtgcttatgtgggtttgaaagatgacatggagaattctggggctaatgttattgaagctgatgttgttgtagataaaaatattatcacatgctcttactattctgaatgtgggaaatttatgaaagaaacttttgcggcagttaaaagatggaacaaaggtgaaaagctaacagaaccattagtggtgtaaaatatgattattgcacttgattttgatggtgtggttgttgatgctatcgatgaatgccttctggtttcttggaatacatttaacggaaaaggatatcagcaatttaataaaaatactttggaatccattcctagatctttcagagaaaaatttctcaattatagaagttacgtgagacatgatgggcattttattgttccctattatttaaatgatgaggtttttgtaaataaggatagtttcgaaaatgtttattctagaatatccacgtctgataaagatagatttagaaattcatttatagaatatagaattaaggtgcgtaatacataccccaaagtatggacgtcactgcataaatttcttatggatattgagacattattaaattcaggaaatgagttcatcatagtttcaggaaaggattctagttctatacattttttattgtgtatgataggggttgaatttcccatttcaaaaatatatggaaggatgaccaataaatctgaaacattaaaatccataaataataaagcgtacatgaaaggagagaaatttatttttatagatgataatttagataatgttaaagaagctattaataatgatatcccttctgtttgggcagagtggggatacaacacaaaagaacaattttgtgaagcaaaacagcttaaaatcccttcgctgaagcagaaagacttaagcgatcttatcaaatcacttcatcaatattaagtgaggaagtatgatcaataatgttaaaagagctttaattatcgtaacatcacatgcaattttagggaaaacgggaaggcaaactggattttattacgaagaacttgctacaccttattgggaatttgttgatgcgggatacaccgttgacatagcctctattaatggagggacagctcccgctgatccaagtagtgttaaaagttccgaccaacaaccaaagtctgtgcgtcgtttcctcaacgataaaagctgtatgaataaggttaatactacaaaatcaattttgaatattgatccgaatagctatcagattgtctttcttcccggtgggcacggtacgatgtgggattttgctcaatctatgtctctggcaacgctacttagcaagctctatcaaaacggtgctgttcttggttctgtatgtcatggtgcagccggattgttgaatgtaaaaactgctgatggtattccacttgtggaaaaccgaaaaattaattctttcactgaagctgaagaacaagcctctggtttagataacgtagttcctttcatcctcgaaactgagctcaaaaaactcggtgcacattttgaatgtgcggctaattttgaaccctatgtagtatctgatggtcgtttgataactggtcaaaatccagcatcttctggtttggtagccgctgctattctcaaggctgctaatcatctttacaataaggagtaacaatattatgaccaaagaaattctttgtggattcggtgtgggtgtagacgcggttgccggttggttatcttcgtatggtggtgaagattcaccaagtgacatttcacgtggaatgtttgctggtgaaatcggtgttccacggcttcttaatttgttcaaaaaatttgatatcccaacaacttggtttatacctggtcattcgatcgagacatttcctgaacaaatgaaaatggttgtagatgcaggtcatgaaattggtgtacataattacagtcatgaaaatcctattgatatgacgccggaacaggagaggatagtcttacaaaaaagtattgatatggtcaccaaattatctgggaaaaagccaacaggatatgtggctccttggtgggagttttctccatcaactacagatttgctcttagagcatggcatcaaatatgatcattctcttatgcataacgatcatcttccatattatgtacgtaaaggtgattattggacgaaaattgattacacaaaacatcctgacgaatggatgaagccgttgatcagggggaaagaaactgatcttgtcgaacttcctgctagttggaccgtagatgacatacctccttttatgtttatgaaaaataaagccaatagtcaaggttttatgaatccgcgtgatattgaacaactatggcgcgatcaatttgattgggtgtatcgggaaatggaatatggtattttcacttttactattcatcctgatgtttcaggcagacctcatgtattaatgatgcttgaaagacttttggtacatatgttgggtcatcctggcgtaaaatttatgacactcaatgatattgcggatgatttcaaaaaaagaaatccacgataataaaaatataggctatttaaagcagccatttctggctgcttatttcatccaaagtaaccctgttgagctaagttgattatatgatttttaacatataaaactcttgggtgccgcagtgcgcttttattccacacaagataaaaattattctctggaatattagtattatggtttattttgaaaactttcctgcttttaaatccatcttcgcataaatattcaggcataacggtccatccattattatcacttataattctcccaattactctgagatcagagatggtaattgatggtaaaatatctgcctcaacaccaaaaactaatttataataatctctaattagaggtaattgattatcgtaggaaattaatgggtatttttctaatatttcagggctgattgatttgttctttaattcagctgctatagatgctgatgttactataatgagtttttcttttcctatgatttcaaagccgaatttattttcatctgggcaagatgttgtaaaagccaaatcactatctccatcattcaaactagaataaattttttttcggtcaccaatcaacagcttaaatctgagctgtttattaatgattgaggataaaatatttgctgattttgcccatagaaaatcagctggagcaatgatcttcacgacaccttcaattttcttcgattttccacgaattaatgagagtttggtttcaatcgcatctaaatgagtccctatttgaaggacaagatcatcggcttcagccgtaggtataacgccatgggagcgacgagtaaataatacactacccataaatgactctagagagtgtacatgtgcagatacagcaggctgactcactcccagcctcgttgcagcttttgaaatcgaaccagatctataaacatcaagaaaactacgtaattgaataagatagctcacagacagttctcctcttccagaagtaactcttgttcaatggtcatgtaaaaatattgaattacttgttgaaatataaatgatattaaaatacttatatcatatgcaatataaatttatttttattatgtctattctatatttattatgatcttacatagtcataggatattttggagtcgaatatgccgtttgttatttatattttttctttgtgtgcgtttgctctcggactgacagaatttctggtgattggacttgtatcagccatatctactgacttccatacatcagtagagtctgttggtttaacagtcacggcttacgcagtaggagcgaccattggagccccattccttacagcagtaaccacgagatggtcacgaaaaggtgtaatgctcactacaatgatgattttttctatcgggagcctggcggcaacattttccagtagtgttgaaatgatgattgtttcgagatttgtcgctggtcttgctcacggactgttcttagctgtttcagctagtgtcgcgactgatcttgttcctccagaaaaaagtggggcagcagttgcatgtgtttttactgggctaacactggcgcttgccttaggtgttccaataggaacatatttaggaagtgttgtatcttggaaatttagtttttctttggttacgatatttggattaatcggccttatcggattgatttttttgatgccagccaatacaggaaataaaaatgatgtgattgcacacccggtaaaatcattatcttatatatttagtcctactcttcttttaggtgcacttgttactgtattaggttatacaggtgcatttactttgtatacatatatctcccctttcctttatcaggtaaccaaagtttctattcagacagcaagttatatgatgttgatttacggaggatttgctgctgctggaaatattataggtggaaaaatgacagatgctatcggagcggatcgctctgtcatgatcatattattgtcactgagcgctgatttactacttatgtactttttcgggcaatcattgataataatgggtattctaattgcaattattggtgcaatttcttatgcggcagttcctgccatgcaagctagagtaataagcattgctaagtataatgttcctgaagcaattccggtggcttcggggcttaacattgcaggttttaacgcaggaatagctttaggctccgttgtggggggaataattatttcttatttatccattgcttaccttgcattaggcggtgttgtaatatcattagctgggatatgtgtcatgatatttctccctagaccaaccaagattttgatcagtcaggatgagtaatatgttttaatcttatgtttattatagatattctattttaataaaacaggatactttgatagataggatggttgtgtattcaaagcgttgttcttaagttataatcaccatttttatggggagaacttgagtggcaacagtggaagtaaaatgccgcttttgtaaccaaacaaaagcggtgaaaaagtatggtaaagggaaaggggtcaccagcgttatcgttgcttttcctgtcatcgcactttccaactggattattcttatcgcgcctgctatgccgggataaaagaacaaatctttgatcctgctatgaataattcaggtattcgtgataccgcacgggcattacatatcagtattaatgctgttgttcgcaccctaaaaaactccgccaagatgggtaacctggataatttggaaattcagttaatctgtgaagttgacgagatgtggtcttttgtcggcaataaaaaacaacaacgttggttatattatgcttgggaaccccgtctgaaacgtatcattgctcataccttcggaaggcggaataagaaaacgctgaagaagctattgaaaaaactcgctcgattcaacgtagctttctggtgtacagataatttaaatgcttacaatatgttacaaacgaataaacacctcatcgggaaaagtttcacgcagcggatcgagcgtgaaaatctcaccattcgtaatcgaattaagcgattaaaccgcaaaacattgggttattcaaagtcgccggaaatgcatgataaagtcatagggacttttatcgaaagagaatattatatttagaatcaatcaacggattgaatgcataacccgagcatccagtggtccggtgatattacgtccatccgcataaaagagggctggcgctatcttgccgtggtgattgatttattttcccgtcgcgtggtaggaatggcaatatcttcctccccgaatgctgagttggtatgtcgggcactgaacaatgcgttagaaacgcgttatattgaaggccgactgatttttcactcagatcaaggaagtcaatacagcagcaaaaagtttcgccggttactctggcgaaatcaggttatccaaagcatgagtcgaagaggcaactgcgatgataatttcccaatggaacgggtattccggagcttgaaaagtgaatggatcccaccagaaggttatctggatattcatgatgcgatacgggatattacccaatatctgggtggctattacaatcaccaacgtccccatcgctttaatggcgggatgtcatcggttgaatacgaaagaggttgggaagaggctaaaaatatgtccgatatcttttgaccactatacctcagttttttaccatcagttgatacaccttaatagtgcatttctgcgtttctggacattgcttgcagccaccgctcaggcaggaggaagtatcgacttcctccagtttacccattgtgacgagctgtttgagcatggcttctaccatcggtagcggtgttgaaaactgatggctcagtgaccttgcatcggtgcgcccgttgagggcgacagcatcccggattttcaacaggctaatcatgtctggctcctagtgacagctaccgttagagcattcgcagctccggcctgcggtgttattgaacgtcatggtgactctgctgcgagcacggcgtaagccgataaagaccagtacgttaaatacaatcacggccagaatggtaatcaggctgctttgtggatgcgccgaaaatgtcgtgacttgatagaacactgccgccagcgaataagcgacatctaatccccacaggatggagaagagcatccagccacggctggtttcacgggcaatcgcccccattaccgaaacacagggtacgtacagcagtacgaaaatcagataactgtaagcggaaatggcggaaccaaatttggcactcatcgttcccatcgcgccgctatccatattgccatcgcctttactggcctcaatcgggttggaaagggcactcagggtaaatgtctctttcaggctgtcccatgtctccgcaacggcacctttcagttcattcagcagatggaattcatccggattgaatggcgcttggttgaggttctcagcggtatacagggtattcagcgtaccgacgacaacctcttttgccatcgcaccggtgatcaggccaaccgtcgcctgccagttatcggaatgtacgccgataggatacaggagtggtgtgatcaccttactgacagaagccagcgcagattcgttgatgttatccaccgctttgccggagaaggagaaactattcagggcaccaatgagtatgctggctgcaacgatcactttacctgcacggatcacaaaacctttcagacgctgccatgactggagcagcagggttttggcatgggggacgtgatagaccggcagttccatgacgaatggcgatgcttcaccgcgcatcagggtgtgtttgaggagcaggccggtcaggacagcgactgtgataccgagtatatacagcgagaagacgatgctggcaccgcttttaccaaagaaggcggcagcaaagacggcaaagatggccagtcgtgctccgcaggacataaaaggcgccatcatgatggtgatcagccgttcacgcggtgcgtctaatgttctggagcccatcacggaaggaacgttacagccaaagccgacaatcaagggtacgaaagatttacccggtaaacccagtgattgcattaacctatccatcacaaatgcggcacgagccatatagcctgagtcttcaagaaaggaaaggaacaggtacatcaggccgatttgaggaaccagtggcagcaccgtgttgatccccccaccaacgccttgggcaaggaaaaccgtcaaccaatccgggaagtgaagtgtgtggccgagccagcgcataccatcaatgaaaatggcggtggaagcaccatcgaatatcggttgcagcgcgccaccaagattgatggccagcacaaacatcagatacatgacgaacaggaaaatcggcacacccagccagcggttcaagatcactttatccatcacttgagtcagcttgtgcggtgtcgcggcatgggtatcaatgacagccaggcacagcgcattaatcgcttgatagcgtgaatcggcgataaccagttccggctcgtcaagctgctgctgttgcaggcgcattttgctctcagcgagctgcgactgcgttagtcctgctcgctcacggctgtaaatgtccccttccagcacctgcaaagtcagccagcggcgctgttgcgggttgaaattctgagttatctggctggcaagatgattgacttcctgcaacagggaatcgggatattcaatccgtacaggttgggaagacggttgataatggtcgatggctttcttcagtgtatcgatccccgtggcacgggtagaaaccagcggaataaccgggcagccgaggcgttgctccagcgccgcaatatcaatgttgatatgttggtttttggcgatatccagcatattcagagcgacaatacaggggatgcccagttcaattagttgcagcgagagatagagattgcgttccagattggaagcatcaacgacattgatcaacatatcggcttcaccactgagaatgtagtggcaggcaatctgttcatcaatggaggtctgctccgaaatggtcgtgagggaatacgttccgggaaggtcgacaagctcgatttgctgctcatcggtggtaaaacggccggtcttgcgttctaccgtaacacctgcccagttacctacccgttgccgggagccggtgagttggttgaacagcgtggttttgccggcattcggattaccgatcagacctattgttaattgtttcatcatactttttgccaatcagggaatgagactttctgtggtatttggttggtgactgtactgaatttcattcaagtggggtgttatctagtgtgataaacgctaagtcttttttacgcaggatcagattgactctgcgtgtttcgatttgtacaggatcgcctaaaggagccacgcgaatgacctgaaatgtggaaccaggcaacatcccgagtgacaataatttctgccgataggcggggctaatctgtgcagaaaaccccagaattttataacttcgatttggaagaagtgacatataaacttccattaaaactgaaaaggtaagtgattataagaattattatccctaatcaagcaggaaccacaagaaaaaagtacgtttattatttctgatcctgattgtgaatgataataatagtaaatattcatgatatttatttatcactgaatttttatggaagaaattgatattaatcaaattaatggttatttaattgaaagtaaatgacatttctattattgtatatttaaattaataatcatttattaataaatagaatgaatgatttaaacgtgaaagatgaaatgaatacctgctattacaagccccgataacatatgaggcttgttgatttttatttttcgattagtattacgaatgtttttattgattttcaggcggatgagtcaattcactcagtggaacaaaaacgcggccatcatcttgttgattgtgccaaagttcggaatcgtatacccaccactcttgaacgtctaattcataaaaccgccggcggccatggccgtgaaattcactgagaggccgggcttttttctttctgatattttcatcaggaaaaaggaagttaaagtagtaatcgtaagtttcctgcaactcattgtccgggatttcgtgagcctggccgataaactgtgcccctgcaagatccagtgatgtgtcaggattgacccggttgtggtaaagcgagccactgactaatgggttgatagaaatttcgtgcgaatgacgggtaatcaattttgaataccagatcaggcgtaatggatcgtatcttggaacatacagcagtgacgctgaccaaggtgagcctgaatcaggatggtgagtggcaaggctgaaaaatcgtatattgctgagtagatcaaaactgcttttagcatatttattcataactttttcctcaacagaatatatctgtatatcagagcattatggaattattaatttgttatatttttatattattcaataggatttcatgaatatgaaatttattgaatgatagattatacggagtattggcaggaatcgtcagttataatcactcattcaaatttgttatattagtaataaattaaatcaattttatgaagattatgacatttttactgatggggtgtgtgggaaggccgtttattttcctcttgccgatactggcctttttaaatcagattgttagcgatgacatcggcgtttagcgtggttttttcgttccattggacgtcgaccccctatcttagtcgataaatcaaacacaccaaaaacagacgattcacaaatttatggatagatttctctctggcttatccacaaagattgtggataagtttatatggggtagacccaacagtcgtgtcaccagccgccattttgactacggaagttcaagacgagcattcatattgagtcgaaccgtccatatggattgacgtgttcccatatcagtggcgtcagagcagcataatcccggggcgtaaattttccctcctaatggggttgggacaatacttcctggatcatcagtgtgttgatatcaatcatgcagttttgaatcaggtgcagcgccagcatgctgacttaatgagcttcgcgaggattactcgtcatctcaccacggcgtgcaaagaatacaaaattagttacaccattccattgtttggctacattcagttcttcgttaactttcctacgtaatgttccgttcaggtagtggcacaaaaaggactaacgggggcatttgtgcagaaatttacggtttcatcttgttgttggtgtggtcactttttatatgaatgtgttatattaattttttaattaaaaatggatatattgtatggatgagaaagatgatttgatgtaaaaatagataatatcatggttaatagttcagtgaaatctgagggaaaactagctgtaatgatgatattctgttttcaattattgtcagtaactcaaactgatatgattaaaatgcgtgtttcggatggtagagagttggtattaaaatttgaagaaaacaaagttaatcattgattgaggttatatatggaattcgatagtaacagccatgaaaatgccatacaggaagcgcaaaggattttaaaagaagctcaaactgatcttgctttaagattggaaaaggcggttgaaggtgtaagggaagttgcacaggaaacaatgcataccataggacaaggagggcagagagctttatggagaacttcatatttttttgacagttatgaagatgtatatcaaagaataaatagagaagatgcaagggtatttctcgcggcttggtcggtagctagaggaggtttatttgaaaataatgttataaaaaaaattgttgatatttacatagataaattattagagcctcatgagcgtgatcaggcttttttaaatgaactttatgaaaaattagttcgttcgtctacaatcatgatgcatttagtcgctaaatttaagacatcaggtttggcaaagaatgctgttgtttctgccataacagaagctatctatgtagcagtaattaaaaaagcatttattagggaaggctttaagaagtttggaatgtctatcactttagcatttcaattttatggttattttgataaggctgctgtatctgcgagtaagttaaaaagagaatgtcctgttttatactggtctttttatgctaatgagatagagatgttgtattttatttttgaacctttatttaaacatggcatttctacaataaaaaaaggaaaagggagtaatgtagatgatgtttatttagctataatggaaatcgttggttataactgaatttcaggtcatgttagtcaggagctaagatatgtttagtaaaggatggttaagaagagaaataatgtcatggcttaagggaatttattcttatataatatggtcttttattccaactctatgtgtttttagttggtctctttttgcgtttgttattttcccaaatcattgggggttgttaactgtggtaggtattattattgttttattatttactgcttattttgcatttaaatctaactaagcatattttatatgcttagttaatatttttaataaattcgttcatcccatatgctataagctgatgttccagctgttatatgactccatgcgatagatttatattttagctgtactttttcatatggcattttatcattactgttaattgaatttggataaacacaggatatatcaacaattgtcgcttctgttatttttaattcatagaaaagttccaattgccctgatgagcttgttctataaaaaataaatccaccattcagtgattcattagaatctatagctatggataataatggtgaagatttatctattggttttatgaattgtattgggtgatgacttacgttttgatctctagtcatcgaatgatctaagcttaatacttgtatttggtcttcgtgccctttttgataccgatttcctatagaatcaagcgttgaacaccctgcggagattaaaccttgcttcttgccgtttaaagttaaatagatcatgtatgacataaagattaccatcctagttttttattcaaatgatgttaactcgatagatatttaggctaaaaaaagtaacttaacataaaaaaaaggttctgtcgcattaacggcgagtttatcagtcgcatccggtgtgattatttttcacacagttcagtcgataaaacagctctgctggcgataaattctcgccttcattttgaagacattgtcctttacgcggcatgatgactaactctattcctatcagcaacgtttgtgcccggcggaacgatttaaatcctagcatcgaatggacccgacgtttgacatggcgatggtcttgctcaacgaggttattcaggtatttattttgccggatttcaatcacctgctgaggcgattcttctgcattgagaaggtatcgctttacggaaaaaacgcagggctgctgttgcatcgcggcgggctgtcagtatcaaccgcccgataaaggtatttccactgacctttcactttgatataggtttcatccatccgccaccgggaaccaatgggttttttgcgtggtcggaaagccttgccgagcaggggcaccagacgtaacacccagcgatgtatcgtggcatggtcgacctcaatgccgcgctctgccatcatttcttcgagattgcgcagactcaaggcataagcgaggtaccaacgaacacattgggcaatgatatcgacaggataatgcagacgtttgaacgcttttcggataagggacatcgttctggactcgctcaaaaacaggggtgcttacctgatgaccgcttaatgcgacagaaccaaatatattgtggtcgcacaccaatagagacattattggaaggaaaatcaatttgggctgaaaagaatctaacccgaatttaatctgacaggcactaaatcaaagtgggcaactgtcaaattaagtctgaatgactacatcttagtttgtttgctgtttcttgattcaagaatacgcattaatttatcaaagtctggtattacatcaccattgtatattattgtgccgtcaggataagtcattgatgtatctgcatccttattttttcctccattccaatgagttaaaaattttttttcatataagacattaagatgaatttttctgccattatccattttatatgtcataacatcatgctctcctaccaaataaaatgattgactatgcccccctaagaacctctctcttagtaaaggaaatagagtaatttcttcatttaaattacctgttttttttatatatcccccatcaaattcttgtggtgcattaccatcaataacaaatgtcgttttaaatccaaaattatcgtcaataagaggcgcaattgttgacgtatctttcagtttcacttcgaaagtaagattactcagtttccaatcacacttcccccctccctccttagggacactgacctcaacttgatttgactgaccgattgatagcgggtaggtagcatgatgaaaacccggaacagaatacgatttcatattcgcagttcggcgttctttgcggcaaattttagaacgatacatggctgaaatgggtaaggcatccaactcatccggaatagtggccataaaatgaacattctctccattaatcggtggagagaatgatccgctttgcgcacatccttgtatgaaaaacacagcaagcaggggggataatacgcgtttattacagagaaatttcatgggtgctttccttgtatcgttcaaccgaatttaatctgacaggcctaaatcaaagtgggcaactgtcagattaagtctgaatgactacatcttagtttatttgctgtttcttgattcaagaatacgcatcaatatttcatattcaggtctaacctcgccataaacaatatcgccattaggatatgtcataaatggcctgtcattgttctttctatcagtccaaactgaaagcattttttttatatatatgtaacttaggttaatgtttttagtcgctcctactttatacgttaacggatctcctttccctataagataaaatgaagtctcatttacacttaaaaataattttgttagaaggggaaataaaattattttttcatgcaaatttccatttatttttaaataaccgccatcaaattcttgtggtgcattaccatcaataacaaatgtcgttttaaatccaaaattatttttaataagaggcgcaattgttgacgtatctttcagtttcacttcgaaagtaagattactcagtttccaatcacacttccccccgccctccttagggacactgacctcaacttgatttggctgaccgattgatagcgggtaggtcgcacgatgaaaacccggaacagaatacgatttcatattcgcagttcggcgttctttgcggcaaatttcagaacgatacatggctgaaatgggtaaggcatccaactcatcaggcatagtggccgtaaaatgaatattctctccattcatcggtggagagaatgagtcgctttgcgcgcatccttgtatgaaaaacacagcaagcaaggaggagaatgcgcttttattgcatagaaatttcatgggtgttttccttgtatcactcaaccgaatttaacctgacaggccctaaatcaaagtgggcgactgtcagattaagtctgaattactatttcttagtctatttgctgtttcttgattcaagaatgcccattaactttttatattcaggtctaacctcgccagaaacaatatcaccattaggataggtcataaatggcatgtcattgttctttctacccgtccaaactgaaagcatttgttttatatatatgtaatttatattaatttttttagccgttcctattttatacgttaacggacttcctttccctataagataaaatgtattctcattgccatttaaaaagctttttgttagaaggggaaataaaattattttttcatgtaaatccccatttatttttaaataaccgccatcaaatactgctggtgcattaccatcagtaacaaatgttgttttaaatccaatattatcgtcaataagaggtgcaattgttgacgtatctttcagcttgacttcaaaagtaatattactcagtttccaatcacacttccctcccccctccttagggacactgacctcaacttgatttgactgaccgattgatagagggtaggtagcatgatgaaaacccggaacagaatacgacttcatattcgcagttcggcgttctttgcggcaaatttcagaacgatacatggctgaaatgggtaaggcatccaactcatcaggaatcgttgcgataaaatgaacatgctctccattaatgggtggagagaatgagtcgctttgcgcgcatccttgtatgaaaagcacagcaagtagggaggataatacgtttttattacatagaaatttcattggcgccttccttatatcgctcaagagcgtgtttcaataattcatcctggttaacatcttgtttaaaaatatcgtgcaggttattttcgagtgccataaaagtggtgttacgttttgcattcagtggagaggcatcttgatgatgtattaattcatcaaatttctcttttgaagctattagcttaggcgttttcgttggctctaagaaactgagcaattgattatttataatggcttgatatttactgcccataaagtggtctgttgccgtcgttataatcgtatctaaatcaggattattccattgtgggaatatttcatcgagaacagacttatctccctttaatgagtccacatattcctgttgttcattctctagtcctttatctaatgaattagctatgctcggaactaaataaaacttatagatgccattcatgcgccatctttttttacccgtaaaaccgacaccattcttacttggaattctttcttcacccatttgtctcgcctgaaagaagctcacggtattcccttggtgataatagacttcacccatctcggggagagatttttgtattggaatggtcggcaatgttgccaaagtccagctaaagccaaaaatggttcctagtggcccataaacttcaaataaccagttatccatattggtatcaaatggcacgctcgttacgctatcggcatcattgacatgtcggaagtgattcagtgacgttaaggctttaacgccacttccagtgaggactctcggcattccatacgtataaaggagcgggttattatttcttagctctgtggcgtgcaataaagcaagtgccccccccaaactatgaccgcagataaataactttttaagattaatatgttgtgatgattctttgatttgtttaatttcatttataaaatatttttccatgcactgataagcttctaaaaagcccttatgaaccttggcttttccaccgggaagaatattctctgggcatggaatagggcggtaagtcccatccgtcagcgcatctctcgagcttgccgtccctcgccatgccgcaataatttgcgtttcattttcaacaaaaaacatttgagtatcatgctcaaacgtttcaggcgtttccacttgttcaacatccaggaatattgccggtcgataacgttctttaaatggtacatcgtttacaatcgcgggataaacggaatgatcattgataacaggggtttttgataagtcaaagcattgctggtagaaaaaagaagtggtcgtatcgggagtattaataaatttcctcatattaatatcaggagaatctgggttaaccatcacttcattcttatacaccaatagtgacatgagtcctaggttatacgcattcactatatcgtagtttggtgtatgttttaggattaaagaccatgctctaaacggacatacctcaatcacatgacgttgattaaaatcctcaccgtaaaactctaatcctttaaattcattttctttcggaaaatggtagtaaggtagcccaaacttagcttgttcccactttgcaatattaggggctttgtcacacaactcaccaatgacagcataacgataaaaataacctttggattcggcatctggcttgactgttgaatgagactcaccacgcaatgttcgtaatggtcgtgtttccatctcatcggcaagtttttgcccacggagaaataaacgtataggagaagcaggcaatttatctgctcggatcatgccgttttcatccgtctttcccggacgctcaactttactattttttaaaatatagtccatcttagaaatgggtttattgtgttcatcaacaagctgaatttctattttgttctttaacattcccgggcaattatgacaataaaccgaattagcattactcataaataggtgctcctgttatttttcttgttccatagccaatagataattctgaccggacatattttcaatacgttgtccggcttccagcttttgtctcaaccactgctcaatccgtggttctaaactgccttctggctgatccaatttcttcgccattacaccgtggttttcccatagatcgttatagagagagctgcttaagactttcaggccataaggcgaatgcagccaaaccagttgtaggtgttcgcccaatgtaaaaggaatatcgtcattgccttgtccacattccttcggacggtggaaatgtgtggtctgggacaggtcaatcatcagttccgtgacaggagtcagcatcagtgaccagtcactgggcgtgaaggccgataccatcgcgccaaatacccgtgtatccatcatgcgaaatatcacttgttcgccattcaacgtcaccaattgtcgtcgttgccagtgggtaagctgttcctgccacgacttatggcttcgataagcccaaccccagctgttgtcactgagttcatgtttatctagcactgcaccaatctgaaataaatgatttactttcgcctgcaccagccacgggctttgtttcagcattttgcgcatcggcgtaccgctatataacggaaaagcttcttctacccagtcattgagataaaagtgtgccaccggatcaggtttcgccagtgaattgaggataaaaaatacgggcgcatcattagatttattcagccattcttgccagcttaccggggattctgtgtcctctgcgggaattgcattttccattattacggttactccttggctggtttaataacgggactgacgtcttgttgtgccagttccgggcaataaggatgtgccggaaataccatttccacctccggcaacggctccacgccctccggcagttgcaggtttaccccgcgtccgctgccgcctgagccttggccaacattaatcggtgaagacaaaatcccgcccggggtcactttgagaaaactgccgcccactttcagggtaatttccgatgccgcttccaataccattttgccgccgcttttcaggtgaatttcctgcccgctatcaatcactgtggcatctcccgtctggatatgctggctgccggcaatccggtgtgacacatccccttcggtggtgatttttctggaaccggcgacctgatgatggtcatcggcgcggatatcgtggtagcggttgttatcgatgcgctgtttctggtcatgtttgatatgccagtaggcatcgttttcgatatgggcggtaaagtctttctggccgtggatatagacttcctcgctgcctttcgcatcctcaaaccgcagttcgttaaaacctttgcctttatgggttttggtcttgaaggtcgtacgggttttttgtgccggtaaatccagtggcgggcggttcaggccgttatagacagaccccgtgacgatcggtcgatcaatatcgccgttgaggtaggagataatcacctcctgcccgatgcgcggtatcgccataaagccaaagccatgaccgttccagccttgtgccacccgtacccagcaggatgcgccatcatccgcgttgtcatagcggttccagtgaaaatggattttaatggcaccgtctttattgacgaagatttcttctccttcgggacccacgacgatggcggtttcatcgccatctgctaagggcttgtaatagaacggcggacgccagtcggcgaggccgtcgataaagctgaactgattggagagtgtcgtgccatcaccgccatcatgacccagtgcctgtgggcagcgcccatgatggctgataccgacaatctgccagcgggcattcaatggggcgtgcgggtgatttttgatctcgaagattttacccggcatcagtttgatgcagttactgtttccgctgccggtctttttctggttatccagcgcttcatgacggtattttaagaacggtttggccgccgcatctttctggaaacgcccgtagctctcaaagacggtataaggggtttgtgtaccaaaatcgcgaaaaccttcactgctttccatatgggaaaggtgataacgcggattgtcgtagttaaagtctttgtggaggctgcgttgcggactcattccgacgcccagccgtacctgataaatcgtatctatcccatgggcagtttccggttgcgggctgtaagtcagcggcagcccggccgtcatccccagatgactgtcgctgaaaaatgccgtttcatcctcaaaccagaaactgatgccttcttccgcggccagacgattgaaaaatgcatagtcagattcccgtttctgggtcacgtattccctgtcctgattgagcgtcagacgccagagggcagggcgcaccgtcagggtatagagggttttattgccgtcggtgcctgcccagtcggcgtgggagatgataccggtgattttgcgctgtgcgagttccccattaaagatttgtaacaccgcttcctgcatcagcaaggcggtcaaatccacttccgtctggggtttaaacgggttcagtgtgtgcgttttgaccagcgtcaggttcagggtaaacagctcagataacccttcctgcagggaaaattcccccacgctgaacgtatcttcaggaagccccgcgacctgaaaagtaaatcgtaatccacttttggcagaagacagcatattcatcatgttttgttttgctccttattgtgctttctctattgcttacatatccctgcgtaatccatagacttcccagaattcccacagggctttgtgacagttcggggtatacacattcagcttgacgaaggtggactggccgacaaaacaggccatagcctgattaatcaaccggcagaaacggtacatctcccccggattggcgtagccgtcagggttcagtgtgagtgacaacaggtgaccccggacgggtctgcccttatacatcctgtcggtcaggcgttcctccacccggacgatgccgtcaatatgccggcggatatggcggctcagcggacgattgagttcggcgtaagggtcaaacaggcggaggaaatgtttcaggctttcggtagtaaataacaacatcggcgggctggagaggcaggaaagcagcggccagccggaattatcctgtaacatcgacgggtaatcggtggcgaccggcgtaatattgtgcacattgagatgggacggggaaccttcctgcatcacggtgagggtgcctttttccagcgcaatggcctgttcatggtaaccccaggaatgacaggcgacggcgatctccggtaagttcacggcgggtcggccggtcaggtcaaaaaaatggagctggtgcgtcagccttcccggcaaatcacgcgctgtctggagcaggtagtaaaaagtgtcagcttccccgtcttctgccagccagcccattgccggggtaaactggtcaatgggcaggtagcggtatggcgtgccgcgttgctgtttctcatcaggctgctgaataacctgaatatcgcgcagccggaacaatcgcacggactccccgagcggcaggggatagcgatgattttctggcgtcagcggaatggggaggctggtcagattttccagatgaatggccgggacgcagcccagcataaaggcatcatcaacgtcttccagtggcaattcgccttcaaaacgaaaaatgagttcaaaggtgccgtcggcattcaacggcacctcacggcagtagtcactgatatccaccgtcataaagttataaagctggggcagcgcataatattcaatgagagactgaagcccggcataagtgtgtttttccatcggcaggatgggggtatcgaacagattgtgccagccataaggaaaacagctcagttctcgctgttcaccccggactctcaggctgacgtcactgatatgttgatccagccacaggcttaatagcgccgcctgttcactgtccgtaccgaggaaaaaagacagtgacccgctttgccagacgggggagggaatgcctgtctggcaaagcgtcagcactatctcactgtgtgtgccggttttcttcaccgccctgtccagcacgataaggggttcgatatgcagggaacggcaggttttaaacgtgagtaactgcccgttgacatgggcagaaaccggcgtgcctgccgggatatcaacggcgccctgatgttctccgtcggtgggatgaaattgcatgaccgtcgtaggcggaatgggactcagggccagcggccagatacgggaaagaatgccgtgggtaatttcggggaaatcatcctcaagtttatcccgtaagtgggcgatcagcagggcaaacgcttcgaagacacgttcaatatccggatcatgagaggcaagcagaaagtcggccaggtgaggcgattctttcgccacgcgttgagccagttccctcatataggctctttcccgcaggtacatagactccttgttgtttttcattagctttctctttttatcctaatgtaccgatgaataattcatcggcatgttatgcgtaaagtttatataaaatcagtatcctgccagaggttgggggtttattgtacgggcttatcaattatcattcttaatgaactttgatttttttatgatttaggaaaagtcttactaacgatatccatcatggttgaaagggtactgaggccggatagcagagttgtctggctggatgcgcctgaacggttctatcgcattaacagagaaagtttgtacggaggtggggatgatgactatttatggagtcaatcgataaaacatctctgccggtgacaatgtcttatcttcgggttgtgagtattgccctttacgcagcatcgaaacgagttctatccccgctaaaatcgtttgtgcgcggcggtattggccccacttttatcgatagtcacgacggcgggtctgccgtgctggcgtattgctttacggaaaaaacgcagggctgccgttgcatcgcagcgggctgtcagtatcaaccgccccgtaaaggtctttcgtctaactggctcaggtgagccagttagacgatgattatcccgaattaacgctttttgccgaatgcagcagccagagcatcactcatggcgctgttggacaatgccgttgatcccggagagcgggaagtctggcggtttctgccattaccattgcgctcgttgctattacgcgggttactgctctgagaaccgctacgacgtgccggagcttcgccgggttgctcatcaagacgcatagtcaatccgatacgcttgcggttcaggtcaatgtccatcaccttcactttcacgatatcgccagtcttgaccacggtatgtggattttccacaaaacgatcagacagtgaggagatatggactaagccatcctgatgtacaccgatatccacgaaagcaccgaaattggtaacgttagtgaccgttccctccagaatcatgccggcgcgcaggtccttcatggtttcgacgccatcagtgaaagtcgctgtcttgaattcaggacgcgggtcacggccgggtttttccagctctttcaggatatccgtaacggtcgggataccgaatttatccgtggtaaagtcctgtgcctgcaaaccacgcagggcgccaggattgcccatcagttcagacagggactgttcggtagtggccaggatcttctcgacaacctgataggtttcagggtgaacggttgaggcatccagcgggttatcaccctgattgatgcgtaggaagccggcacattgcaggaacgcttttggccccagacgattcactttcaacagttgattacggttgtcgaagcggccgttttcatcacgccagttcacgatattctgggcaaccgacttggatagccctgcgacgcgggtcagcagagcgactgatgcggtattcaggtcaacaccgacgccatttacacagtcctcaaccacggtatccagctttttggcaagctgagtctggctgacatcgtgttgatactgaccaacaccaatagattttggatcgattttcaccagttctgccagcggatcttgcaggcgacgggcaatggaaacggcaccacgcagtgaaacatccaaatcagggaattccaatgctgccagttcagaggcggaatagacggatgcacctgcttcactgactatcactgcctgagccttgacgtcagggtattgtttctggatgttagcaaagaagcgttccgtttcacgggatgccgtaccattaccaatggcgactaactcgacttgatatttggtgcacagagcggcaacggcagcagcagctttgacttcttgcccggtatgcgggtaaacggtatctgtggcaatcagcttgcctgtagagtctacgacggcaactttcaccccagtccgtaaccccggatctaatcccatcgtggcgcgcatacccgcaggggcggccatcatcagagcgttcaggttacgggcgaaaacgttgatcgcttcatcttcggctttctcgcgcagcgtccccatcagctcagtttccagatgcagcagcaccttgatgcgccatgtccagctcaccacggctttacgccaactgtcagccggcgcgttattcagccgcaggttcaggtgatcggtgataatctgttcgcaatagctctctttaggagcttcctcaaattgaggatcggcattcagagccagttgcaggatgccttcattgcgcccacggaacatggccagagcgcgatgggatggaacggtggcaatcggttcatggtgatcaaaataatcactgaacttggcgccttcctcttccttaccttcgacaactttggcggccagatgcgcattcttccacagatattcgcgcactttcaccaacagagccgcatcttcggcaaagcgttccatcaggatataacgtgcgccatccagtgcagccttggtatcggtaacgcctttgtcggcatcaacataggcggctgccgccagttctggcgtttgttgcggatcttgccacagcaggtcggccagtggctccagcccggcttcaatggcaatttgcccacgggtgcggcgcttgggtttatacggtaagtacagatcttccagttcggttttactctgcgtggtattaatcgcctctgcgagctcaacggttaactttccctgttcctcaatagatttcagaatagtctgacggcgatctgatagttcgcgcagataacccaggcggctttcgagttggcgaagctgagtgtcatccaaacctccggtggcttctttacggtaacgggcgacaaagggaacggtatttccctcatcgaacagagtaatggcggcgaggacttgctgtggttgagcctgtaactcaccggcaatgattcgacttaaagattcattcatagactgttttcttcaactttcttagcggctgtagatatcatcagaattgcacagacagtgccagattcatctaacataataatggcatggttcaaactggctccatttatacgtgcagagcgcgataatttccagtttagcgcgatatttcggtcatgttgagacagatttcatcgaatatcttatgggttaagatatagtactccgccattaatcatattttctcaagtgggttttttcatggcgaagagtaactacattacccgagaaggctggcatgcgcttgatcaggagctgaaatatctctggaaagtcgaacgccccaacgtaactcaggctgtttccgatgctgcggcactgggagaccgttcggaaaatgccgagtacatttatggcaaaaaaagattaagagaaattgaccgtcgtgtgcgatttttatccaagcgacttgatgcactgcaaattgttgatcctgatccgagacaggaaggcaaagtcttttttggtgcatgggtgaaagtcgaaaacgaaaaagccgaagaacatatttttcgtctggtggggccggatgaatttgaacctgccaaaaagtggatttctattgattcacctgtggccagggcgctgcttggcaagcaggtggatgatgaaatcaccgtcatgactcccaatggtatggcgatttactggattctggagattggctaccagccgttggggtaaaccacggagatagggagcaaggatggcaggcagaaccataagcaattgttgataatgccgtaaacagccttaaaatacatgaagttagtctctactgaagtttggggtttctgtgagagtaatggatatggcgggcatggagcatcttgggagctgaaacatgcaagagagttataaaatccttgttgttgatgatgatatgcgcttgcgggcgttgttggagcgttatttatcagagcagggttttcaagttcgtagtgtagcaaatgcagaacagatggatcgcttattaaccagagaatccattcaattgattatactggatttaatgttgccaggcgaagatggcctatctatctgtcgaagattgagaagccagcataacccgatccccattatcatggtgtcagcgaagggggaggaggttgaccggattgttggccttgaaatcggcgctgatgattatctcgtcaagccttttaacccgcgtgaactgctggctcgtatgcgagcggtgatgcgccgtcagagccatgagttaccgggggcaccaacgccggataatgcggtagtgaagtttggcaaattcaaactcgatcttggaacgcgtgaaatgttccatgaagatgagcaattgtccctgaccagcggcgaattttctgtattgaaagttttagtttcccaccctcgcgagccactgtcgcgggataaattgatgagtctggcacggggaagggaatatggtgcaatggaacgctccattgatgtacaggtttcccgtctgcgccgcttgattgaagaagatcctgcccatccccgctatattcagacggtctgggggctgggatacgtttttgtgcctgatggaagcaaggtatgaaaaggctctggctctctctgcgcgctttgttctcccatgttatttatttaactttggtaattgtgctgggcagcctgatgatcagttatctggctgcccagagactggtcgagatggaaaaactctcattcgccatcgtgttcttttatgtctttgccagtgttttcacggcggcttcggctgtttctatcaccttctggttttacctacgcgcccagagacagccattgagaacgatgcagaaagcagtgagagagatggaaaaagggaaaatagcagcaccactccccgaagcgggagctcctgccatacgttcgctgatcagggcgtttaatcaaatgtcgacagcgcataaagcgctggagacggatcgcgctagcttgatagcgggtgtgagtcatgacttgcgcacaccattgactcgcatacggctggcgctggaactgatagaagggaaagacaattttcttcgggaatctatcaatcgtgatattgaggagtgtaatgcgatgatcgatcaatttatcgattatcagcggtctgggcaaaatatgccaatgttgtgctgcgagttgaatgggttgcttgatgaagcgataactgtagaaaatgacggcgtcgggaatattgaaaatcatctgtcagccaacccggttgtcattatggctaatcccctgtcaatcaaacgcgtcttgagcaatatgttcactaacgcccatcgctatggacagggatggattcgggtcagtagtggcgttacggaaaagtttggctggtttcaggtggaagataatggcacagggatgacagaagaagaaagcgctaccctgttccagcccttcacacaggggcaacgcgttcacaataatgggggggcaggtctggggcttgccatcatccgacgcatcgttgatatccatgatggttacatcgaagtcggaagaagcgaaaaaggcgggttgtccatgcgcgtttatatcccacgggtgacgaaataataatgtcccttcaaaagaggctgtcataaaaatgtcataattaatacattttgctgtcattgaattaacttatttttcccctgaatccttttttcagataaaaattattcagatacaggcaaagttgttgacgtagtttgacgcttgtttttaattaatgatgcgtatcccagcaggagggagtatgaaaccaatgcgtaccaccgtggcaagcatcatggcagcagcacttgccatgacatctctgtcttcgtttgctgcttccagtctgacgggagcgggggcgacattcccggcaccggtatataccaagtgggcagattcctatcaaaaagaaacgggcaataaaatcaattatcagggtattggctcttcgggtggtgtgaaacagattattgcccataccgttgattttggtgcatctgatgccccgctttctcatgaaaaactcgaagctgatggcctgttccagtttccaacggtgatcggtggcattgtgctggccgtgaatatttctggtattaaatccggccagttggtcttggatggcaaaaccctcggtgacatttatctgggcaatatcaagaaatggaatgatccggcgattacaaaactgaatcccggcctcagactccccgatcagaatatcgccgtcattcgtcgtgcggatggctctggtacttccttcgtcttcaccagctacctgtccaaagtgaatagtctctggaaggaaaaagtcggggtgggttcgacggttaaatggccggccggcttggggggcaagggtaacgatggcattgccgcgttcgtccagcgtttgcccggttccatcggttatgtcgaatacgcctatgcgaaacaaaataacctcgcttataccaaattgatttcggcagacggcaaagtcgttgcgcctactgaagcgaatttcagtgctgcggcgaaaggggcggattggagcaaaagtttcgctcaggatctgacagcccagaaaggtgacaatgtgtggccgatcacttcaacgacttttattctgatccacaaacagcagaaaaatgcggcgaatgggattgaagtgctgaaatttttcgattgggcttatgagcagggcggaaaacaggcgaaagatctggattattctgtcctgccgcaagacgtcattggacagatacgtgcagcatggaagcgcgacataaaagacagcagtggtaatccgctgtactaaaattatctttatattaaccgttgttgaatcggtcactttgattcattccccctttgcgcccttttgctgagggggaaattaacccaaatgagaattaagcgtatggccgaacgtaaaacggcactgaaagcaccaagcaaaaatggcgatattattttcagcgcactggttagactagctgcgctgatgacgttatttctgctggggggcattatcatttcgctgattattgctgcctggccgagtatcaaaacttttggttttggttttctatggaacaaggattgggatgcgccggcagagcaatttggcgcactggtgccgatttatggcacattggtgacctcactgattgccctgattattgccgttcctgtgagttttggtattgccctgtttttgacggaactggcacctaactggttgaaacgtccgctgggcgtggcggttgaactactggccgcgatccccagtattgtttatggcatgtgggggctgtttgtctttgctcctctgttcgccacttatttccagcaacctgtcggtgatgtgctgtcgagtattcccatcgtgggagaactgttctccggcccggcttttggtatcggcattctgacggcaggcatcattctcgccatcatgattattccttatatcgcttccgttatgcgtgatgtgtttgagcaaacgccggtcatgatgaaggaatccgcctatgggatcggctgtacaacctgggaagtgatttggcgtatcgtcctgccttacaccaagaatggcgtgattggcggcgtcatgttggggcttggccgggcgttgggggaaacgatggcggtgacctttattatcggtaatacctaccaacttgacagtctctctctctacatgccggggaatagcattacgtccgccctggccaacgaattcgccgaagcggaatccggcttgcataccgcagcattgatggaactgggactgatcctgtttgtgatcacctttattgtgctggcgttgtcgaaattgatgatcctgcgtctggcaaagaatgaggggcgctgagatgaccacgggtaataatcctcagccacgtgcggttggcgcgataaatacggcggagatgaacaaccgccgccggatgcaggcatggcgccgacagaaaaaccgtattgccctgttgttgtctatggcaacgatggtatttggcctgttttggttgatctggattttattctccaccgtcaccaaaggcattgatggcatgtcgctggcgctgtttactgaaatgacacccccgcctaataccgaaggtggcgggctggcaaacgccatcgtcggcagtgggctgctgattttctgggcaaccgtgtttggcacgccattgggtatcatggccggcatctatctggaggagtatggccgccgctcatggctggctgaagtgacccgctttatcaacgatattctgttgtcagcaccttcgattgtcgtcggattgtttgtttactcggtgattgtgacaaaaatgcagcatttttccggttgggcaggggttatcgcattggcgttgctccaaattcccatcgtgatccgcacgaccgaaaacatgttgaaacttgtcccggataatctgcgcgaagccgcttatgcgctgggtacaccgaaatggaaaatgatctctgccattacgttaaaggcttcgatatccggcatcatgaccggtgtcttgctggcgatagcccgtattgcaggggaaaccgcgcctttgctgtttacctcgctttccaatcagttttggagcaccgatctcagtcagccgattgcgaacctgcccgttaccatcttcaagtttgccatgagtcctttctctgactggcagcaactggcgtgggcaggagtcttgctgattaccttgtgtgtactgctgatcaacattgtggcgcgtgtgctgtttaagaataaaaagcactgatattttcaatatgcaatgaaaaggcatttaagagagaagcaactgatgaataaggctaacgacattgcaggaagcaaaattcaggtacgtgatctgaacttctattacggcaaatttcacgcgctgaaaaacatcacactggatatcgagcagaataaggtgacagcctttatcggcccgtcggggtgcggcaagtccacgttactgcgcactttcaacaaaatgtatgaactgtatggcgaacagcgggcagaaggcgaaattatcctggatgacaccaatattctgaccgataaacaggatatcgccctactgcgtgccaaagtcggcatggtgttccaaaaaccaacgccattcccgatgtccatttatgacaatattgctttcggtgtgcgtttgtttgagaaactgccaagggctgaaatggatgaacgcgtccaatgggcgctgacaaaagccgcattgtggaatgagaccaaagacaaactgcaccagagtggttatagcctttccggtggtcagcagcagcgtttatgcattgcccgtggtatcgcgatccgcccggaagttttgttattggatgaaccgtgctcggcacttgacccgatctccaccggacgcattgaagagttaatcagtgaattgaaatcggaatataccgtggtgatcgtcacccataacatgcagcaggccgcgcgctgttctgaccacactgcatttatgtacctcggagagttgatcgagttcagtgacacagacacgctgtttaccacacccagaaagaaacagactgaagattatattacaggccgttacggttgatatggggcatatagcgtatggacaatctgaatcatagcaaacacatttccggccagttcaatgcagagctggaacatattcgcacggaattaatgacaatgggtgggctggtggaagaacagctcagtaaggcgattctggcgatgcacaatcaggacggagagctggctcggcaagtcatcgaagatgaccagaaagtgaatatgatggaggtgacgatcgatgaagcctgcgtccgtatcatcgccaagcgccagccgaccgcgagtgacttgcgcctgattatggtgatctctaagaccattgcagagctggaacgcattggtgacgttgcgaataaaatctgtcagacggcgctggaaaaattctcgcatcagcagcagcccttgctggtcagcctggaatcgttgggacgccatgctatccagatgctgcacgatgtactggatgcttttgcccgtatggatctggaagaagccatccgcatctaccatgaagataaaaaagtcgatcaggaatacgaagggatcgtccgccagttgatgacttacatgatggaagatccccgcactattccaagcgtcatgaccgcgcttttttgtgcccgctccattgaacgtatcggggatcgttgtcagaacatttgtgaatttattttctattacgtcaaagggcaggatttccgtcacgttggcggcgatcaactagaaaaactgctcactaaagaccaatgatcttaactgcctgaaacgcgggaattttattccggcgtttttggctttcttattcctaaaaatgataaacatatcattttatattatttcaagtgctatattgaaattgatagcttctgtcggacaataaatattttattaccaacaggggtgttcaatgaaatttcgcaatcaatcccgcgtagcgactgttgcgctgctgaccagtctggcattggtttctggtgtggcgaaggcagataaacttgatgatattaaaaaaaccggtacggtacggattgcggtattcgacagtaacccaccgtttggttttattgatccgcaaacgaaaaaactggcgggctatgatgtggacatcgccaacgcggttgccagtgatctcggtgtaaaactggaattacgtccgactaacccagccaaccgtattcctctgctatcttccaagaaaattgacttaattgccgctaatttcacgatcaccgatgaacgtgccaaacaggtcaatttttccatcccttattttgccaccggacagaagttcattgcccgcaaaggtgttctgaaaaccccggatgatatcgctaagctgcgtattggggcagataaaggcactgtacaggagatcacgctgcgtgagcgttatccgacagcaaaagtcatctcttatgacgatactccactggcatttgcggccttaaggaatggtaacgttcaggcgatcacgcaggatgatgcgaaattggttggtttgctggcaaacgtaccggaagcgcaaaaagcagattttgaaatttcacccttcagcattacccgtgaatatcaggcggtagccgctaccaaaggagaagatcggttgattaatgcggttaaccagacgctgctgaaactggaaaaagacggtgatgcagagaagatctacaaccgttggtttggtgctgagacgaaatcggctcagccgcgtggtgattttaaattcgccccattagacagtcaggcaaaaccttaatctactttaggaaaataacgcctgaaactagccccgtttttgcggggctttgctgtttttttatgcggtgaatgatatgtttgagcaatttattaccgaacacttactggctcctgaatatctgcgatggctctggcaggggttccttatcaccttatggctttctgtctgcaccatcatttcttctaccttgctgggttttatgattactgcagcgcgggacagccagatcaaaccgttgcgttggctggttacggcttacaccaccgtattccgcaatacgccactgttggtacaactgtttttctggtatttcgcttccggtcaaattttacctcaggccgccatgatttggctgaatacctcccatgaaatccccattgcgggtctgacactggcatggccatcctttgaatttttggcggggtttattggcttgacgctctattccgcgccttttgtggctgaggaactgcgggcaggcattcagggcatcggccgtgggcaaaaatacgccgcgcatgcattggggctgacggactggcaggccatgcgctatgtcgtattgccgcaggcattgaaaatcgccatgccacccctgttggggcaatatatgaatatcgtcaaaaattcctcattgacgatggcgattggtgtggcagagctttcctacgcttcccgtcaggtggagacgcaatcactgcaaacctttgaggcgtttggtgtcgcgacggtactttatatcgccgtcattgccatcatggaaggttggggacagtggcgtcaacagagaatactggtgaggggatactgatatggactttaccgttattacggaaaattggcgctacttgttgctcggcacctttcctgatgggccgttggaaggcgcggcgctaaccttggtgatcagtatcatggcaggggtgatttccattgtcttgggtacggtggcgggggttgcgctggcgatgctgcgtggcttctgggttaacctgctcgcggcaatattgggcttcttccgtgccattcccgtgattatgctgattttctggacttactttctgctgccggtggtactgggaatggaaattcccgaaatcaccactgtggtctgtgcactggcgttgatcacctccgcttatttggcgcatggcgtcaaagcgggcattctggcgattggtgaaggtcaatggcgtgcagggttatcgctgggcttcaaccgttgggaagtgttgtggtatatcgtcttgccgcaggcattgagaatgatggtgccgtcatttattaaccaatggattgccttaattaaggatacttcattggcctatattgtgggtgtggcagaattatcatttttagcaacacaggtaaataaccgtagcatggtatatccgatggaagtctttttatttgttgcgctggtttattttgtcatgtgtttatcactggagctcattgccaactctgtcgcccgccgtttttcgatgcaacggcaaagaacaacactgttcggtttctggcgtaaaaaaacattgataatgattccgaaaattaatatctgagcctgatcagatattttatggttgtattaattccctgctgttaaaggcaggggattttttatatcactatcttttaagatggctattgggtaatgaaataagttaagaaatgttttatttgtaataataaattaatccagaatttcaaaaagcaataattttttcttatcggctgataactatttttcattaatagatatttaataatttcttctaatatatcaagatggaataatagcattatcttttttctacatggatatttggtgatgagattttgttgcttatagacattctgaggttctcatatatgttttcatattttagtaaaatcattcgttttgttattgtgttatatgtattaattctaccgtctacaatgatgaatgcctttgcggatggcaatgttctgattgaaaaaacagataatcatcacgtaagtaacaaaacgtctgatatagacttttcggttaatgattcaagtaaaaaattcttgaattcgacgaccaataaaaaggataccatacaaaaaaacgaggatatctcagaacccgatacacctaatagcattgcaagacatcttcagaccgcaggcaacatgctgtcctcttctccttcgcaattggccgaacaagctaaatcttatgccttgggaaaattaaatagtaccgtcaataatgaggcacaaaaatggttatctcagttcggtacggccagaattaattttgcgctggataaaaagggaaagctagagaacagtgcgtttgatatattattccccctttatgacaataaagcggactggttgttattttctcaagtcggttatcggaataaagacagccggaatacactgaacttcggtttgggaggccgttattttcagaataactggatgtatggcctgaataccttttttgaccatgatttcaccggcaaaaacagacgattgggattgggcggggaaatctggggggattacctgaaactctcggccaacgcgtattatcgcttaagtgactggcagcattcacgggatcacaaagactattacgaacgtcccgccaatggttatgacattaacggggaattcttcctgccggcttatcccaatctgggcgccaagctgacctatgaacaatatttcggtgataacgtgaccctgttcaaccgggatactaaacagaaaaaccctagtctggcaaagttagggctgacgtatacccccattccgctggtgacgataggagtggattataaacaggggggaagcgggcataccgaaacccagtttttagcgaattttaattacagactaggcgtcccgctcagtgtgcagttatcctcggataatgtcgcatctatgcgtacgttggcaggcagccgttatgatttggttgagagaaattacaatattgttctggatcatcagaaaaaacaaaacctgcaattgtccctgccgggagagattgtgggttatagccatgaacagaagacagtcacagctaaattccacgattcatctattaagaaggttgagtggatatctaatggcacgtttaccgacaataaaggccaactgtctgacaacaaagatcatactgcgaccattacttttcccaaatattcacctgatggtaataacaattacccaatccttgcgattggaatgctggagaacaaccagaaattaccccccgttcagatgcatgtgattgtcaggccgtttgtggtgaaaaaagcggaagaaggcacatcatacatcacccccgcagggccattacccgccagtggtaaagataaagatgcctataccattacgccggtgattacttttgataccccggtaggcgccccggtaaaaaatgccacgattgatgatgtcaaatggataactgagccgcctgctgatggtaaatctgggctgaagttgagttgggaaaaacaagagacaactaagacggatgagaatggaaagttacaggccgtgactttaaccagtactaaaccccagcagaatgtaaaagtttatttgcagatgggcgatgctgataaagagaagcaattagtgggaacggtgagttttggggaagataccgcgcgttttcatgtaaacagtattcaggttgaacccaaagaaacgctgactgctgacggaattcaagcctatacatatacggcgctggtattggatggcaacaatcagccagtgaaaaggcagaaaattgataaggttcactgggatcatgataaggaagataaaacgggattgaaatggaagagcaggggagatactaccgacgaagaggggaaattaaccgcggaattaatcagctctgatccggtaaaagatgtcatggtcacgttatccatagaagggaatacggataaatctgcaaaagcggataaatcggtttcttttgacgcagcaaacgtcaatttgggactttcaaaagtcagcccgatattggtgcgtgatacttatactttgaaggtaacggctaaggatgccagtgataatcctgagacaaataaaaaggtgacatggccgcaaagtcaaagtctgccgcaaggggtaatactgactccagcgagtagtattactgatggtaatggggaggcgactgcgacattaaccagtactgaggaacagactgtggatgtcacggtttctgtagagggtgtcggagagaagaaaacgagcgtggagtttaaatggccaacgattacgttccagcctgcttcgccaaaaaatggtgttgttgctgatgggaagaaaggctatcaatttatcgcaaaggtcgtgggcgctgatggacaaacaccttatacggataaggtgtttcaatttaagtggcatcttcagctttcacaggatgctgttcagggaaagacctatttattgcatgaagtcacagataatcagaataaaacatggacagctcaactagccagtacccagactcagccaaaacccgttgaaggtgcaaaagtttgtttggcgattgagggagggccatcgacatcaatggcttgttcagagccagtgagttttgttccacttcccgcgaatgttgaaatcaaatctattgaagttaattttgaccctcaaaaaccattaaaaggtaattggagtgattcatatctctataaggcgttggtttttgataagaatacaaaggaaaaactggctaactataaatttaaacccagtgaaatacattggagccgtgatccagactccggcaaggttgatgatcaatctcttgctttatttgaccaagatcttgaaacagatcccgatggttatttaacggtgaaactgaaaagctatgtggggattaaaggcgttaaggtgaaattgatgatatctactctgtatggtaatgagcctggggcagctgaaacagcagtcgattttgaagttgcaccacagttagctgggctttatctctttaagaaaagtgatccaacaaatgttaataagttctttcctgaacaggaaagaccttacaatgccattggtggtgatatgagaggggagctaagaacgctggataataagcctcttgataacccggaatatacatgggagcccaaaagcacagatacaattctacccggtgaaaataaaggtacatttatgatcaacaattttggaaaagtgacaatcaatgctcaagttaaaacatcctatggaaataatttattttatgaacgatggtatgtatataaaattaatatgcttagactttttaatagggcaggtcagagagattcactttatgatctttttgacgagaaaataaggtgtgaaaatattgcttcctcaaaagcatatacacccaatctaaaaaatatcaaagggtcaggaaagggtgaagcgctttctgaggagtttcctaatgcttattcttggggattatttgatggtttagactttcctaatacgagggaaaaagaatattttgctagattcagagttgataaaggtgaatcaccaagtaatgggtatgagctctataatgctgcctatgataaaatgatggacagtagcattactagtgcctttttaatttgtgtgactggtcattaatctatgtattttacggaagaaaatccagacacagatttaatctcattgaccatgtgcttggttagataagcctgattaatatcagattttatgagaatattttcattcacatatgttgctagaaaaataatatttatttattatgttgatgaatgtaaatattaacaatgtaaattgtttatggtgttgttttttgtaatattgttctataaatatgtgataaaaaatagttatcatgtgataactatttttcattatatttttttaatttaatattgcatattgtgtgttaaattttgataaaattaataatatgtgaataaagatttcattataaataaaaccatatagggagtaaaaatatttcttgataaaattagagtaaaactctatgaaatactgcaacttatatattatcttaaagtgctaatgtttatttaaataaacattatttttttgaagattaaaatgagattatcattatggctagtaatataacaacatctcctgctagtaaatcaaaaataattgtaggtcaattactaacggctaatattacttttgaatctgatatagcaatgtcaactaatatttcttttgaattaactaatccagtcaatcttacaatatctaatactgatttttcagtgttagataactctaagagttttactgttaccactaaatttcatattagcgaaaatataaatgaaggtgatacagttagttttttgattaaacctaatgatcatgcaattgcacttggttttaaaaaacaaacaattagttattttcctcatgatgtagacagacattcattaaatatccattttgatcaaaccgtcgtggatgcattaactacagataagccgaatataccaccgaatggtcaatcatatagtttagctactgcattagtcacagatagaaaaggtaagcctcttgctggagagactattacgatcataggagggtttgcggctaatttagataaggtaagaatatttagttccaataagaatgtgcaatcagaaataaaaaagaattcactttatggtcagtcgtctattgatataaatactgacaaatacggaaaacttgaattttatgtttatccaagtgataaatcacaatttgtatttgacttacaagctagaataacagatgcaacacagtttgtgtattcagaagataggttatatattttgaatgacgatcagggtgacccatttaatgctgatcaacagacattagctcctcctgatattttagaacgtcaaggagataagctaactgaaagtgatggctcatctacatttaccgctttaattgacaattatgaaggtgaaagcgagaatgatagtatactattttttgttgatggaaaatatgctcatcaacaatttttaactagcaagaaaaaatataatcatggttatactttccaattgccttatagcattttaccattaaataagtatgctggtttttcttatattatagttactgtcgatggaaaccttaaattttcggctggaatggacataatgtataatggtggttcaaaaaatcagccattggataatgtaccaagagtttatgacatgtgtactgtatattctagttttgggtattccaatgcatctgatttagtactatataatgatatggttaattgttttacaatatcccgccatttgaagactaagcttaaagcggggttatatgttgcaattactggcaccaatgatcctacagataaaactaaagtaccgtttggaactgaggtgacattgactttatacatcgattcttataagaaaaaaacaaatcagatatttaaaataaaaatgccaactcagcctgatgaaggtagcaaaaacatagcaacatatataatcccaattccttataaatatgtgaatgaagttggtgacattttctaaatggtgcggcttggggagtatttatttttgattattaaatcaatgaggtcaggttaaaattatcctacgggaaacattttggattgcatctattgatacgacctctttgtatagacccag
